United States Patent 10,233,495 (METHODS AND COMPOSITIONS FOR SCREENING AND TREATING DEVELOPMENTAL DISORDERS) - sequence listing, part 41

SEQ ID NO: 457 - DNA, 4997716 bp, Homo sapiens (residues 3,331,813-4,997,716 of 4,997,716)
cttcaatattgtgttggctattatggatcttttgcctctctttatgagttttagaagtaattggctgatacacatgaaattaatactgggattttgattaggatttcctcaaatctataaagtgggaaagaactgacatcattaaaatattgacactttctatctatgtgcattgaacatctctccacttatttagatgttttaaaaaaattgttagaattttgtagtttttcttatataaaatatgtaataatttcttagatttatacttaagtattttatatttttggtgctaatttaaatggtattgtgtttttaattccaaatcccaattgtttactgctgtcatttaagagaacgattaacttttgtaaattatccatgtatcctgccgatttgctagaattacttatgagtttcaaaagttttttgttgtaaattctgagatttttcaacatgaaaattatgtcatctataaacaaagacaattttattgcttctttttaatcagtattccatttatttcattttcttgtcttattgtgttagctaggatgtccagcatgatgatgaagaggagtggtgagagggcacatctttaccttgttcttaatcttagtaggaaggcatccagtctgtccactattatgtatgatgttagttgtaggtctgttgtagatattcttcatgaagttgaaaaagttcctctctactcctagtttatagagcatttttaaaaatcatgaatgagtgttgaaatttgtcaaatgcttgttctgcatctattggcatgctcatataattttccttctttagtctgttgatgtgatgaattacattatttgatttttgaatggtgaactccctttgaatacctgcaataaatctcacttagtcatggtatataatttttataaattgttggattcaacttgttgatatttcgttgagaatttttgcgtctatgttcatgagcaataattgcttgtagattttctttcttgaaatatctttttcaggtttaagataatgttgaccacatgaaatgagttaggaagtattcttcctgcttttgtttttgtttgtttgttttttgattttttttttttttttggaagagtttgcagagaattggtataatttctttgttaaatatttggtacagttcaacaataaactcaatctgggcctgttgtttcgaaaggttttagaaggctgttaatttgtaattcatgttttaatagatttaagactaccagattttttatttctccttttatgagttttggtggattgtgtcttttgcgaaaagaacatagaattgttcatagtactcctttatttctgttttaatacttacggaattaaaagcgatgatgactcatttattcctgatattggtaatttgcatcttttttcttggttagtctagtttatcaatattttttaaaaatacttttttaaaactagcttttggtcatgtttattctcattgatttactgtttttattgatttctgctctaacttctattacttatttccttctgcttgctttacacctctttttctagtttcctaaggtggaaacttagaatactgatattagatttttcttattttctaaaatatccattctataatacaaatttccctctaagcaccagtttgactgcattacacaaattttgatgagttgtgtatttgttttcaaatattttaaaattttatcttgaaaatatgttgttccatatataatttagaagtgtttaatctacaggcattttcttgttttccagctatttttctggctataatttttaatttaattctattgtggtctgaaagcatagtttgtatgatttctattcttttaaatgtgttaaggtgtgtttgatggccccaaatatgttatatttggtaaatgctctgggtgagtttcagaagaatatgtaatatgtatggtttttggataaaatatctgtttggtaaatgctctgtgtgagcttcagaagaatatgtcatatgtatggttttggataaagtatcctataaatgttaattaggtccagttgattgatggtgctattcagttcaactatatccttactttttcctgcttgctagatctgtcagttatcaaagagggatgttaaagtttccaactgtaatagtaaatttgtcatattctctttgcaattctatagtttttgccttacgtattttaatatttttgtgttaggtgtatgcacattaatgattgctatattttcttgaagaatttggcccttaatgattatataatgccccatttttttctctgataatttttcttgctccgaagtctgtacttactgaaattaatatagctaatctagatttctttttatttgtgttagtgtggtatgtctttctccaacactttactatctgtctcttttatttaaagtagattttttgtagacaacatatagttggttcttgttttttgactcactttgataacctctcttttaattggtgtttttagatgattgacatttaaagtgattattagtatagttagattaacaaataaccgtatttgttagtgtttccagttcattgcctttgtggggtttttttgtttgttagtttgcctgtgtgttttatactttttttctgccttctctggttttaactaagcattttctataattctatctcctttgttagagtatctattacgtttcttttttactatttttaatgattgctctagagtttgcagtactgcagtataaatttgcaactaatttaaaccaatttttaaataacactatactacttcatgggtaatgaaagcatcttataacatattatctctagttttttccctttcttatttcataactgccatttcacttcacatattcatagccaaaaccactgagtatatggtgctattattattttgacaaaaatctgtaatctgttagatcaattaaaacaaaaaaaaaaaaagagtctattataccttcacttattccttctctgatgtttttcatttcttaacatagatctgagattctgacctatatcatttttttccccctctgaagaattctaacatttcttgcaaggcaggtctattggaaacaaatgcccctagttgttttgtgagaaggtttttgtttctttttcacttttgaaggataatttcacaggatacagaattctatgttggtaatttcttctttatttttctttggacactgtaagtatttcactctaccctcttcttgcttgcatgctttctgaaaaattggatggagtgtttacctttgcttttctttagctaagctctttatttcttctgacttctttaaacatttttttatctttgatttcctatagtttgaaaatgataggcctaactgtagactttttatatttatcctacttggtattctgtcattcatttcagaaaattctctgccctatgactatgacttcaaacattttctctatttctttatctctttcttctacttctggtattccaattacacatataacttttgtggttgtctcacagttttgaaatattttgttttatcctttttttctctttgcatttcagttatcaaagtttctattgcattttctcaagcttattgattctttcttagtcatatccagtctattgatgattccttcaaatttctgatacagcatcttttatttctagcattttcttttgattctttcttggggtttttatttatcttctttcagtttctgtatgttctttcatattgttagattgtttctactttttccaatatcgccctttgcatattaatcagagttgttttaaattcccattctgatagttccaacatggctgccgtacctgaatctcgttctgatgcttagtttttcccttcaaacactgttcttaaaaatatatatatatacatacatatatatatatatgccttgtaattactcgttgaaagctggccataagctagcaagtaaaagaaacttaggtatatatgcctttagtgtgagtgtgtatgtttattcagttaggagttaccttgtatttactgtttgctctaggtgtggtgtcagggctaattttctctgatgctcttgtttttgtcttttttgttgtagttttccctagtgactcttacatgatgtttgacattttcaattccttcatctgtattatcctattatcttctaggagctccattgaggtaatgatagggtgttgggggagaaaaaatgttctgtaaaattatgattaggtctctttcttttaccaagcctgtgtccttgggctgtgaccttcacaaatgcttctcacttttactttcttttatttttctatgaaggtgaggccttttggcctcatctaattggagctgggcgtttcctttttgccatgtagaagacgagagtgggcaagagttgtatatttcccttcatacagtttgcttaggttctggtaaaacaccagtcatttaggctctggtaaaatagtttcccttgtgggcaggttttgttaaggagaacagaatattctaaacatatttttaaatggctattttccctttcctctgctggaaatactaggggtttgtttttttctttttctgattttcactgtgagaacatggtagagctcctagaagtaagcttcagaaaagtgtggaggccttcctatgactgagtctccttggagttttaactcttaagcttgtctacctttatcttccagcaattcaattacaagtttaagttttcttaaccctgtgctggctccagcaatggtttctgctcctcaacctttaccccagtaagctatgattccctttaacttcctgtctctctctctccaatttgaggggcaatagattgctctgtgagctcacatttctctaaagaatcctagaggaattgctgattttcagtttgttcagcttttttgttgttgttgcaaagatggaagtgaggccttttaaggtcattacatccttgactagaaattagaatgccactaaactatttttcaatcatttgaaaattttatttatttatcaacttttaagtccaggggtacatctgcaggatgtgcaggttggctacataggtaaacatgtgccaaggtggtttactgcacagatcatccgatcacccatgtattaagcccagcatccattagctgttcttcctgatgctccccagcatcccatcccccaacaggtgtccagtgtgtgttgtttcctgtcccccatgtgaccatgtgttctcatcagccagctcccactataagtgatgacacgctgtgtttggttttctgttcctgcattagtttgctgactataatggcttccgcctccatccatgtcactgcaacggacatgctctcattcttttttatggcttcattgtattccacagtgtattgtaccactttttctttatccagtctatcattgatggggcatttaggttgatgcaatgactttgcattgtaaatagtgctgcagtaaacatatgtgtgcatgtatcttaatagaatgatttatattcctttgggtgtgtactcagtaatgggattgctcggtcaaattatatttctgcttccaggtctttgagaaatggctacactgtgttctccaatggatgaactaatttacactcccaccaacagtgtaaaagtgttccgttttctccacaaccttgcccgcatttgttgtttttgactttttaataatagccattctgattggcatgagatgttatctcattgtggttttgatttacatttctctaatgattagtgatgttgagctttttatcatatgattgttggtcacatgtatgtcttcttttgagaagtgtctgttcatgtccttcgctgactttttaatggggttctttgctttttttatatatataaacttgtttaagttccttgtagattttggatattagacctttgtcagatggatagactacattctataggttgtctgttcactctgatgatgtttcttctgctgtgcagaagctctttagtttaattaaatctcatttgtcaatttttgcttttgttgcaattgcttttggcatttttgtcatgatatctttgcctatacctatatcctaaaggtattgcctacattttcttcaaagatttttatagttttgggttttatatttaactctttaatccatcttgagttaaattttgtgtatggtttaaggaaggggtccagtttccattttctgcatatggctagccagttctcccagcaccatttactaaatagggaatcctttccccattgtttgtttttgtccggtttgtcaaagatcagatggctataggtgtgcggtcttatttcagagttctctattctgttccattggtctgtgtgtctgtttctgtactagtaccatgctgtgttggttactatagccttgtagtatagtttgaaattggatagcgtgatgcctccagctttgttccttttgcttttacaaaacattttagcttgagataatagaagaacacatgcagttatgataaataatgcagagacagtttgtctactctttttctagcttccttcaataataatatcttggaaaactgtaggataatatcaccacgaggatactgactttgatacaatccacttatcttgttcagatttcttcagttttacttgtactgatttgtattcatgtgtatgctttttcagttctatgcaattttatcacatacataggttagtatattcaccacttagttaagataacagtactttcaacatcaggagaattcttcctgttgcactcttatgaccacacccattttcttctcaccttatcccattcttaactctacaaaccattcattggtctccatttctatatgtactacctttttttgatgcattgaatttgtaatatgtacccaagccaaacaatattagaatattgggaagcaaattctccttctatatcgtgattttataaacagcaaaattaaatttcattttatatatgtatatatatatatatatatgtatatgtgtgtgtgtgtgtgtgtgtgtgttctgtgtattatgtaaaaagaagggacacctacttcaaattggatgctagtctaactactcaaatatcatgagttaattctgagatgaaagtcagccatgccaggcgcagtggctcatgcctataatcccagcacttcagaaggccaagacaggcagataacttgaggtcaggagttcaagaccagcctgagcaacatagtgaaaccctgactctactaaaaatacaaaaattagccagcctgtagtcccagctacttgggaggctgagacaggagaatcacttgaacccaggaggtgaagactgtagtgagtggagattgtgccactgcactacaaccgagtgagactgtctcacaaaagaaagaaagaaagaaaatcagctggtgacatttattgtcatgaaattccttctcttgtcactgaatatagaattcttatggtaagagaagataaaagcgaatgtcaaaatggcctctccccatgtgttaacaaccgaatgcccctctcatatgtctgccaaacacaggcggccactttctttaaatatgtaccaagatgagagtatttttgaatgagtggctctaaagctaaaggattcagaggataccagtttagaaacggactatggtggaggctacaagacactggtattttctttactgcaatttctatttctttgagtccataaaatgtaatattactatgtgaaattgttacttttttcattcgtttatgttaatttttaaattcaggagtgaaaacaataaaatggttggtttttaatttcaaatgagactctgtttgttcctcccctgattttcttcatatattgtaaatttatattttcttatatatcattgaaaggtgttttagagggctgggcgaggtggctcacgcctgtaatcccagcattttgggaggccaaggcgggcagatcacctaaggtcgggagttcacgaccagcctgaccaacctggagaaaccctgtctctactaaatattcaaaattagccaggtgtggtggtgcatgcctgtaatctcagctacttgggaggctcaggcagaagaatcgcttgaacctgggaggcggaggttgcggtgagccgagatcgcgccattgcactccagcctgggcaacaggagcgaaactccgtctcaaaagaaaagaacaaaaaaaaagaagaagggttttttagtctaggtgcggtggctcatgcctgtaatctcagtactttgggaagccacggccagtggatcacgaggtcagaagttggagaccagcctggccaacgtagtgaaacctcatctctactaaaaatacaaaaaattagccagtgtggtggcatgcgcctgtaatcccagctactcgggaggctgaggcaggagaattgcttgaacccatgaagcagaggttgcagggagctgagattgcgccactggactccagcctggacgacagagtgagacttagtctccaaaaaaaaaaaaagtgtttttaccttaattggagacactgagctagctttctgctttattttgccaagaaaaaccttagtgatcttatgcatagatttagtgctgaattgatatttgtattgattatccatctcacttttaaattatgcaaaactccaattaaaatataaaaacaaaaatgtgaaagcagggaaggattaggtctttgaaaaatgcagatcagataaatacacttaatttgggacattctttccttctttttgcatccgtattttgaacatatctggttatattccaagaatagacatagatattacagggaaaatctgctgttaaaacatactcagtaactattcactaatcctttcctctgagagcttagtcggctaaatatgatacaatggattctcttgcatgcagtgactgaatgccagaacaagactctaaagacatcgtaatttaaatacccaacggtcctgggagaggagatgatttaatcgatatctgtaacacaaaaggtttagcaaaaagaaagacatttgaacattgtaaaatcagtgaggaggatttaagtttgtacaattttatcaattccaaaaatactatatctatatcaatttatttatttacctatcttactataatgtatatattagagagagagagagataattcacacacacacacctaacacaagcatcctaaaatcagatgaaatttcacgataagcagtatcattagtagcttcttgttcataggacattttatcctgagaaagctgccacatttaaaacataagaatatggaaaaccattattgcatgaatataactgtcctttaacctcattcacttagaaaaaaatgccagtatcagtggtttatgtgtatatttgctttggaaaaaaagattgagtagctggcgagagtattttccttgtctgatacttctcatcccaatttcaattttttgaaatttctcttttatggacttgggtgagtccacattggacaacctatacatgcatttaaaatgaaaaaaggaagttcatgtaaaaagtaagcatgtgatgaatcttatatcctcttcccttattcggatgatagaaataattacttctagatatatcattgcactgggcacagttggcacccaggagttggccaggtgttagatgtgataggaaatgcactgcctgattagacagactagagtccaagtgcaaaaacattctgtcttaaatgagatgagagacagaaatttaaagatgtcatttaatttttcatctgtggccaacacatgccagtgtttcaagatgattttgttaatcacatgggactattcaatgcatgtggtaatgaaaagatagaaacatgtttttttcaaacaaggcaaacactgttcaactcagtttcactgcaatcatttcagttgaggttttttttttttttttaatcttagttgatttctttttatgactgcgtaaaggtattttgctttgtttgcttttactcaggtttttatcccactgtgtcttttttattgttataattcaatcatactctggactctaaggatgctatgggcacaataataccgagaaaggtgccctgaagctcagtgttcttagcaaagaagttgaagatcttttctaaaaatatatgttatatacataagattatctaatttgcattcttaattttcaactatttactgattcaattatttactgattgttaatacatgttaacaatccattgatagcagtaattgccagcatttactgacagtttataatagtcaggcactttgccaagcattttatatgcatcatcataataaatttttgaaattgatactattgaatgtgtcagtttatttcttatattctacatagttgttctcaaagttctttcagggtgttcatgaggtaaaaattattttcatgataatactggcattatttatctattagaatttcacttccttacaaatgttaagagcacaaaaacttattaataatctatattgttttagagtccatattacttctaacctttaaaaaactactaacaatgagttttaatgcagtatgaaagaggaatattctcaactacctaaaaagattattagaatacatctctcttttccaattacgtacatattgaggtcagattctagtgatattttttgaccaaaataatatatcaaaacagactgaaataaaaacaggcatgaagctcagatgtagtataagacattttctagatgtttacaaaatataaacagtgtcactcttttactttttgtttgttttgaaaaattatagttaaatttcacaaaaaggttgtttatgttaaaattgaatttattattttttacatgaaataacaactatattacttaaatacagataggttgacatttctaacattaatagacataaacatataaaaagctggtttttgctttttttttttttttttttttgagactgagtcttgctctacaactgagtctggagtgcagtgtcatgattgtagctcactgcagctgcgacctcccaggctcaagcaatcctcccacctcagcctcccaagtatttgggattataagaatgtgccaccatgcctggctaatttttctgtattttttgtagagatgtggtctcaccatgatgcctaggcttgtcttgaactcctggcctcaagtgattcacctgccttggcctctcaaagtgctgagactgcaggcatgagctactgaacccagccaaaaaaatctttcagtaacttttgatagcctaaaagtattctgacaccaaaatacttcagaaccatttttctaacacattttccaaaagaatgtttttttttttttttttttttttttgagatggagtcttgttgtgtctcccaggctggagtgcagtggcgctatctcggctcactgcaagctccgcccctggttcatgccattctcctgcctcagcctcccaagtagctgggactacagacgtcggtcaccacgcccggataattttttgtttgtttgtttgtttgtttttagtaaagatggagtttcaccatgttagctaggatggtctcgatctcctgacctcacgatccgcctgcctcggcctcccaaagtgctgggattacaggcgtgagccaccgcgcctggccagaaattttcttttacatcatgtgaagtacatatgatttctacgaatgattcagtaggtaaatatgtaattttgttactttattcatatagccaaactctattctttcaacagacaatgtgataatggtaatagcccagtgacttccaagtaaggtgaattttcttcaccaacttaagaattttaaattatgtcttgaaaaaaatttttaaaaacgtaatgcttcctaggttagggaacaaaataattatgtttaagaattacagatgttaaaataattaggtttaagcattacagatgttgttcaagttgtgtttatgagcaagttagtgtgatagcatacacagggaagcaaaacacctaaataagatctgcctggagccaagagggactccccattagaaagaaaaggtaagctagagatttctagcagttgccattagcactggagatacctgtaatcctagttacagacaagtcccacaattctcacaatggattcagggacctgcctgaagtccatgcagtttcgttgatccagagaaggaacacacaccgagtcctcccaccactaccacccaactccctgggaccaaaactgctatgagacaaaaccatgttgggaatggagctacttctggagtacatgagtacatcatagcctggggtttaatagcccctacacctccacaacatttggtccctgccatcattccactacatacacacagaagactacatacagccatgaccccagcatctgagcccacacagtgtcttatattctaggaaacaagaggtccaacatagcagaaggccttcccatgaccaagggagcaagtacatgtgctccccacggccctagaactgactacctgtgactctccatcatcccagctgccacacaatgcatgtgcctcttcagaaaccaaaaacccattattttggtgtccaccataggtggcattgctaccaccaaacctggctaaaccactgtgccaggcatgtacctccccaaatcccaaaagccaatccacccagtagatcccaccctcaacaaagctgtggcactgcttccgtaagcaccaacagtacaggccactaaggcactcaagacacctctgatattgatcaaaactgaagaaatcacatggagaacttactagtgcacccacccagaatgaaaaccaaagcacactacccaactgatactataggacatagctacaataaaaagtatttttctatgaaagctactccatacaattggaagggataactgtttcaccagatgtgaaggtataagtgtaggtacacacacacaagaaaaaaaatttaaaggaaatatgatacttccaaaagaatacaatatatttttttcagtaccacattccaaaggaaaggaaaacaataaaagcctgaaaattaacttaatttaatgatcttgaggaaattcagcaagatacaagggaatacagatagagaatttaacaaaatcaagaaaacaattcatgatcagaatgagaaattcaacaaagagatagatgtcataaaaaattcgtgaacaatctcggagctcaagacatcaatcaataaaataaaaaatgtgattgaaagtttcaacaacaaacaaactcaagcagaagaaagaatttctgaacttaaagtgagactttttaaaataattcagtaaaacactgaaatttaaaaaataataaagaagcctatgggacttatggatcaccattaagaacacagacacttgcattatgggattttcagatgaagaagagacaagaaaagacataggaaagctacttgatcaaaaatagctgaaaacatcttaagttttggaggatacatggacatctagatccaggaagttcaaaagttaccaaatagattccattctgaggttcattatagtaaaaccatcaaaagtcaaagacaaagtgagaatattaaaaacaccagtaagaaggaatccaatcacatataagagagtctctattagattaacagcagatttcttagcagaacttttacaggccaggagaaaaaggaatcatatattcaaagtgctgcaagaagagaaaaagataactatcagccaagaatactactgccagcaaagctactctttagaagaatagcttatacaagctatccttgtaaaaaatcagtagcatttatatataccaataataaactacttgaaaaaatgtcaagaagcaattcacttacaatagccacaaaatataaaacctagaaagaaacttcaagatgaaactatctctacaataaaaattataaatctatgatgaaaaaaattgaataggacaccaacacaaaaaatgaaaaggcattccatgttcatgaattggaagacttgttattgttaaaatgaccatactacccaaagtaatgcacagtcaaggtgatctgtatcaaaaaaaataaaataaaattcttcacagaaatagaaaaaaatcataaaatttttatggaaccacaaaagacccccaatagtcaaagcaattctaagagagaagaataaagctgaaagtatcatacttcctgacctaaaaatatactacaaaactataataaccaaaaaagcatgagattggcattaaagcagacatacagaccactggactgaagacagaacccagaaaaaatccacatatttacagcaaatatattttgaataaaggtgtgaagaacgttgggcaaaggacaatctctaataaactgtgctgagaaaactggaaatccacatgcggaataatgaatccagacccctatatctcagcatataacaaaaacaactcaaaatggattaaagacttaaacataagacctgaaactatgaaaatactagaagacaacatttgggaaacactccagaacactggtattagcaaagatttttatctataaaacctcaaaaggacaggcagcaaaagcaaaaatagacaagtgagattatatcaaacgaaaaagtttctgcacagcaaaacaaataatcaacaaagagaagtgataatcttcagaatagtagaaaatatttgtaaattatgtatctgataagatatcaatatccagaatatggaaggaactcaaacaactcagcagcaaagaaccaaaaatattacttaaaattggtaaatgatctgaatatacatttcttaaaagaagacatacaaatggccaacaagtatattaaaaaagtatccttaatagggatatgtaaatcaaaaccacaatgaaatatcatctcactctagttagaagggctattatcagaaagacaaaacataacagatgctagtgaacatgtggacaaaagggaactcataaactggtggtgagagtgtaaattagtagttattataaaatgcagtatgtagctttctccgaaaactaaaatggcactaccatatgatccagcaatgccattatgagatatatattcaaacagaaaaaagcaatatgtcaagagatatctgcactacctcgtgtattgtagcactattaataataaccaagatatgcaatcaacttaagtttccatcaacaaatgaataaataaagaaaacgttgtatataaacataatgaaatattatttagccataaagaagaataaaatcctggcatttgtggcaacatgaattaacctggaagacattatgttaagtgaaataatctagccacagaaagataaatactacatgttctcactaatacatggaaactaattcagtagaactcacggaagcaaagagtagaatactgataactagaggctggaaaggatgaggaaaataggggacagggagaacttggttaacagatacaaattacagctgggcagaaggagaagtttctgtgttttatagcactgtagggtgactgtagataacaatgatttattctatattttcaaagagtagaatagatgagtttgaatgttcccaacacaaagaaatgatgaatattatagtgattgataagtaccccaatttgattcattacacattgtatatagatatcaaaatatcagactcttgtcatatatgacccatcattatgtgtcaattaacactaacaaaatagataaataaataaatcctaagcaatctaaaaaaaaaacctactaaataaacagtatgaatgggtaagccagactgggacacaatactggcaaagcaaacaaacttcttcagagcataggaaactaataaaaagatacaaaatataatacaaaaaggggaaggatatgaaggcctttctcaaagcaaggtatgttaatggaaaataagcacataaaatcatgctcacatgaacattattgttcatgagggaaaagtgaataaaaacaacaataacaaacatacccactagaaagtctaaaattataaagactgacaacaataaatgtagctgagtacctggagtatctgtaactctaatactttgtcactgggaatgtaaaatagtacttttgctttggagaaagttcaggaaatttattttgaatctaaacacacacatatttcatgacccacaaatttcactttctaggattgaccttagaaaaataaaatcatatgtccataaaaagacttgtcaaaaaaatgaccataggaggcttatttgtaataacctaatactgtaaatattccaggtgtacatcaagagtaggatagataaacccaccgtgttaatctatagaatgggatatgatccaacaataaaaagatttaaaatattgatacacagaagcagatggaaaaatttcaaaagcattatgttcagtgaaagatagcttatacaaaagtttatatcttattatttcatttctatgaaatactagaacaggaaaaactaatctatggttgaaaaattagaatagcatttgcttcaggtgttagattagaggcaaagattgggaaagggcatgagggggtggtaggaatgttatatttcttgctggtggcttggcttacacaggcatatacatatgccaaagttcattaaatagtaaactttaaatttgtttccttgtttgaaaattttacctcaaataaaaaaaaaaaagaactgtaaacaaatattgaaccctagttgatactttgaatgctgaagtgtttaaggagaaagtatattgatgtctgcaccttagtttaacatattcataaaaactataagacagattgacaaagagatatatagaaggatgaatgagtggagcgctatctaacaaaataaatattgtaaaaataatataatttaggtagtgggtatgtgaatatttattattacattcttttacttcatgaatgtttgaaatttttaatagtgtactttggggacaatgctaccaaaaaacaatgaaggcacctctgtactgtgtaacaataaatgtcaaacatcataagctataccaaacatagcaagaaaacttttactttatttttttaatttaagacattagtcaaatctgtaaacatgtgacatttaagaagaactatacaaagtgcttttaaaagtttaggtgaataatcttaatgggatatgatatttgtaattagttttcttgcacatttaatgtacgtatctttgttgttacgcaatgtgcatttcctcgctaagtaaaaaagttacctggcctctcacagtcggaaagcagagttagaatgagagaatcttcagttttaaactgattttagccctagaagttataattaaaagtttcttaatttaacactagaatacaaagtgacttgcctcaggccttttgcttgggtgatagagtgagacaaggactcatgttgtctgactcctagcaaactgctcttcctaatacactatactatcttttattgagcagccaagtttaaatttgtattaaaaaatcatataagactctatgtaaatgttttaatcatttccaaactgctcatatttttgttctttaattgaaacataaattcagaaacaggatattaattttgttttcatttttctacacgatgttctataaacattataaattattctctaataatattacattatatatgtgtgtatacacacacatatgtatatttcctagaattaggagtgttgaaacaagtcccttaatttccagtgagattattagttaacacaatagctaaaaaaatacatacatacctttcaaattgtggaaatcattctataatagagttttatattcaaattacttattcaagaaagatacttttaaaaaatgttatcagacgcaatataattacatttccaaataaaaggacaccttcttgaagatgctcttaagattccgataggtcattttttttaaacttctgaagatcttaattgctttctattgtttggatgataaatgaatatggcaaaaagtttaacaactcttttagctctccattttctcttgtcaacttggcttactaaaggaaacactgagagaagcaaattcctgtgagtgagatcagagagttcagtttattcctacaaaggattattactggcacatgataagatcccccattaggtattgaacattatgttcttaaatttcacaacattttactataaaatctttttgttgagatttcttggaatatagaaagagtagaatttctgtttttttgtcaacttggtaaacctttgaatgaattatatccccagagaaaaaatcatttagtatattccatgttcttaaagaagagattttttttctcagattccactgtgcagtagagttactgggggcaagttcagaaggtttttttagcttgagcttaagaaattttgatttgtagaagcaccccttagatgattttgagatcagtgttcccaggtctaaattgctttaacaatccctacaatttttagaattgatcatataggatcaatcaagtattatctgcatagtctgtatggccacaaccctagtgattctagaagaacattttggtctaatctcaaatcttaggagaagaatttgttgaaaatcaaatctgtgaaaatccaaggaactaaatgccctggatcccctcatagtccttaacaccgaatccaggccaaatgctattgatgatcattgcctagctgactggatttgagcttttgtcattagttggaggctggatcactgtgactctgctcctaccttgaaccttcctcactaattacagaatcagcctgaacttgtacttctaaaaatatgtcaagtgggtttagtcttttcacccagaattagcactgagggctcttgctgtcatggagtatcaccaaagaccgaattatagaactatgttgcagagagcctattttcaaggaagcttgagagagcaggagaaacaaaatttagcattactgatgaacatattcagcaatataaaaactcaaagacaggggaaaaattaatgacatctttttggtaacagtggtgaaaagcaagattttagaaaatagctaccattcattctctggaaagaacaaacgacaacattgtttccatggcacaaaaacagatagagacttttttatttatggaacaaaaatgatatgatcatcagtaaaatgctgtgtagtgaagccaaccctgaagaaatctaggtcagtgaaacagaaaataaactcaaggtgtatattcttgagtctaatgtgtgtatgtgcataaattttgaagcttggagacatcaaataacttgcctgtggtcaaatggttagtaaggggcaggcagagttacaattcaaattaaggtactgctgacctcataggctgggttctagattctaagtttgtgtttttccatcgtgctattcttctgtagtcaatatatatacatacttacatatatatacacacaatacatatatatgtacatacaaggtagatatatatgtatgtttatatacatatatgtacatatatgtatgtgtatgcgtatatgcacaatatttttaccttgtatgtttgtgtatgtatatatatgtatgtatataggtaaatatatatatgtatgtctttagctattgtgttaacatgtatatacatatatgtctgccctgtatgtatatatatatgtgtgtgtatatatatatgcatgtatatatatatatttactacagaagaatagcatgatggtaaaatataaatttagaatctagaacccagcctatgaggtcagctgtaccctaatttgagttctaactctgccccttactaaccatttgaccacaggcaagttatctgatgtctccaagtctcaaaatttcctttctcagtaaaattaaaattaaaacctacttgacatggtcatagggaaaatgcaactaaaaatttatgcaaaatgcctagtatctggctcatggaaatccaataaatgacaaaagattacaaacacataggagagaacattaaaattcatcatgcatttatagtaaattgctaaagagaagtggcaagaaacagaaaaaactataataacaaaaagtaataaacagttaaattacttaccatcctaagtgtcttacatatattagctcatttaattctaacaaacctgtaaagtaagtgcaacatcatcattttacagataagggtattgagtaataaaaataattggaacttagaggaggagtcacagtgtgatattttggaaaggggctataacagtctaggaaaaactgataatttatgtcttttaagaaaaaagttctagtgaaattctacaatttaagaaaataattgttatgtaagtctctaaataagagagaagaaatgctaccaccaccaaaaacaacaaaacattatttctgcagctgctaacatcagaatggctttggaaatctacatgaccaaaaaattgttgcaaataatcaagctagaattcatgtacaaagtggaaagagaaacattcatacacttccaaataattaaaaaatatagcccttctgcgagagcactggagagactgcaggtggaaaattcactactggtgtaatttataaaatcaagctctcatagaaataaataaaaaacatcaacaaaaataaaagattgttttgataaagaaataataatatggacaactattatatggtgccactgagagttggcacataagcaactcctcatcagtatattaaaaattgttctacttgttcctgcataggtaatgccaacctcgcgatagcaataaaagggagaatctgaaacagtgttttcttcttggaaatacatacttactgtacagatccctttgtacactaaacattcattgaaatagccttgttttctacttgtgtttcctatactttgtacattgaatggccaagtttcaaaatggtttggttcaaagttgtgatctaccagaactgcttctcaatccttgaaaagagtcagtagactgtggttatactgcaaggaagaggcagtaggctgtagttatgcttctgtgatatttgtcaggctctgcagaagacttttttaaaacaggcttgtttatttgtcaataaaaatgcaccatctcatgttgttttgacatcctttacaaatacacaattatcttcttttctataaggttaaattccattcaggtacatgatgatgctttcccaatttaaatttgcaaatgaggtagcatagtaagattaattatgcagtacccttggtatttaggggttcacattcaaagtgtgtgtaggaagaccatgagctggtgcaaagattaactctgacattatcactgtttttagatctgccgggtaacagttttcattttatttatgagcctcatattttaaattgacgtttatgctgggcaatgtgtgaaattatttgactgtgaccagacttatttataaattcaatgtgaatactgacacatttcatatgctatttgtattttaaatatattggaaatggtacaattaaaatatctgagtttaaagagtgaaggggagagatacggatccagttaagaagtaatgtttgagtgcacacatatttaaaaagttataaaaggaaaagaagcaatatgaactacttatctcagtgcctgaaaatatgcaggaagcaaaaataagacctgctaacgctggcatatgaaaaggacttcatgaaatgttaacttaacacattcaaaatcatattataattagtaccgggtgagccataaaatgttcctaaaaacacctagaagttaatatgcttttttctctctctctctctcactctctcgctctcttactcttgctatcatcttcatattatcaagtataaaggtcttaattgaaagttgtgttcctagagagtgtgtaccttgtcaaattgcaaaatattacaacctcagatgaagttctcttcaggtattgtgggtctgagtggactcagagcttgagtgaaaacttaaaggtgtagggtcaggttttgtacgtgactggttgccgtttactctgatctgttcaatttaagctggtctccatatgtacaatgatactaacaaggaaaggacaatatatccaaggagttctaacaagttcatcttatgaatcttatgattctgaggcatccaggaaaaggaatgatactataattaccagcaatttttctaacaaggtacacacaatttgttcccttttgtgtgactcaaaatttctgactcacatttagcataattcatttccctttagtgaaagtgtcagtactattcttttcaaaatattccttcttcagaattcccctctgcattcagaatgacatatgatagcaataatagcaataattatagtaataacaataccatgtatttagtgattcaggataaagtgattgacactgaaaacaattattgctagcatatagtaaagaaaaactggtttgttggtaagtagaagcataagacacttggcactattgaaatgatgaaatctgttaccaaacacacagctcactggaatcaatgagtttatcatgcagacggtggcagcagaatactgtggacttttgatttttatatatctctcacttatctcactagtgggcacacagtaggcacttaatacagtgcattttatcagcagggactgccaagtaagcttttcagacaagaagaattgagaaatccttgagaaattaggaaagacttaatttctgaaaaaaaatgatttgaaccagaagtatgtaaggaaattagaatcaaggcatatatcaaaaataaggctaagttaaagcagaagatcaaaaattctgttcgacagtcaagaacaaaaggatgcatatacaagaaaaaaagtgataggttcaaagtctagtcattcagtcaggaacttagcatcaacagatgttgatattaaaaaggaagaaaggaagcgaaggaatgagagatgctagcactaaaaactgtgataaatgatccaagagtaactctagtctagtatttagatgaactcccctaaggaaatacataatgacaaagccagatatgggagtggagacggatgttaatgataatggataataatgataagaacaacaatggtacttctaaactagtagtagataatagacatgatacgagaaccaaaaattctgaaaattgacaagtaagtttgtggaatttactattgtaagtttttaaatttaaagtttacctgaaacatttatttgagtgcataattacaatactgaataaattatataagttttcagatgtttgagtagtaatgtagtcaagtttttatggttttcccttcttgccttgttagtagtctaacaattataattaccacgaatttgatcatatttccctgaaatatttaataatcatatcatgtttatcttaatacccaagatttagaattcttcaactactagcctttccttccagaaagagaaaatggtatcaaaatatcagctccaattcccttggatgaagaaagctgggacagagggagaggaaaggaaagcaatggtaatagaaagaggatgaagtgtaagggggctgacctctatatataaccatgcctctgtcaatggcacagaaaataactaaggcaggtttaccttagagaaaatatgatttcatgggtggcaagtagattttctcattcaattccttcagtaaagatagaagaaaagaccaaatcacatttactagtgatgtaaatatattttaaagaacacaaaaaatttaatacaacaataaaagttgagacaatataattttcttttatcttctttctccatctagcctcttactggaattccctcactctttactcctcttatatagtcctaaaaatgttactttgcactcttcagaaggcattaatcaatggttgttaaaaaaaaaaattcacagagcctgaatctactttacttcaagaatatattttttaaaatgaacataagattttttaatgtcaaaaaattttaaagttatagtagtattacatagtacatcaagttaagtgtattcaacagtttgaaaagctaaaggtttgattgtctcttttcactaagtgtaaaaattaactttaaaatactttgaggtcaaagaaattttagttttgttattccagagaaatagaatacactcttacatgttaatttctaatgctagtcatagaaaaactcaaaaaacttacagatgatgaacagattaaatagggacaaaaaagaagtcaaatgagataaaaattaaaacagtggaattttccatatatttcctatctcatcctatcttcctagccctgatgaaatagaacattgaaggcctatccactgaatattactcaagtcttaaagaattttaatgagtttgtatcctattaaaattcatatatgtcattttataactaagtatgctattaatttaaatctagtggtttttttgcacattcatggtttagattacctttttcaattctttctgtatcttcgtattattttagggaacaatgaagcattaaatttaaaaaatccttcaaatatccactttgagctaaactaagtgaaaaatcatcagtggaaaaacatgctcatattttctaaataattgccactaatctttttgctagcaagaaattagagtgaaataaaaaataatgtatgtaaacttataaaattcaagtttcactctattaagtacacaaaaaaagtaagacatactgtatacttcattgactatttttaacctgtatgacctttaatttgactttatatggcattctacctctttcattgttttatagtgtttgctatttttccattttttcaacagtagaatatagttacaaatgaagagatcattcttttaatttgagacaataatccaactcttagtggttaatatgtattttcctcattttccccaagtaaatttaactgatgactagttttatgtatgacaatagattactgcttttcactttttgaaaaagttatggtaaaatattttaaaaacataaaatttattgccttaacaattttagatatagagtaaaacagtgttaattatatgtaccttgttatgcaacagatctctagaacttcaactagcaaaactgaaacactatactcattggaaaaaacttccatttagcctccccacatgcccctggcagctaccactctgcattatgtttctaaaagtttgactactttagatactggaataagggaatcatgcagcatttttttgtgtgtgactggcttatttcattaaacatgatattatcaaggttcattcatgttgtagcatataacaggatttcctccttttttaaggctgagtaatatcctgttgctaagaaactatcaacatgataaacagaaaacctacagaatggaagaaaatgtttgcagactatgcatctaacaaaggtctaatatccagcatctataaggaacttaaacaaatttgcaagaaaaagaaacaacactataaaaaagtgggcaaaggatatcaacagatacttttcaaaagaatacatacatgcggccaacaatcgtatgaataaaagctcaacatcactgatcgttagagaaatgcaaatcaaaaccacaatgagataccacctcacaccagtcagatggctattattaaaggccaaaaaataacagacactggtgaagttgtggagaaaaaggagcgcttatacactgttggtgggagtgtaaattagtgtaaattggttcaatcattgtggaagacagtgtggtgattccttaaaggcctaaagacagaaataccgtttgactcagccgtcccattactgggtacatactcaaggaaatataaatcattctattataaagacacatgcacatggatgttcactgcagcactattcacaatagcaaaaatatggaatcaacgtaaatgcctatcaatggtagactaggtaaagaaagggggaggggccaagatggccaaatagaaacagctccggtctgcagatcccagcaagaccaacagagaaggcaggtgatgtctgcatttccaactgaggtacccagttcatctcattgggactgattagacagtgggtgcagactacagagagtgagcagaagcagggtgaggtgttgcttcacctggaagtgcatggatccaagggaagcggtgagagactgtgctactcaacccgggcactatgcttttcccatggatttttgaaatccacagatcaggagattcccttgtgagcctatgccaccagggctctgggtttcaaacacaaaactgggtggctgtttgggcagacactgtgctgcaggagtttttttaatactccagtggcacctaaaactccagtgagaaaggagaaccgtccactctcctggaaaggaggctaaagccagggagccaagtagtctcgcctagcaggtcccactccaacagaacccagcaagctaagaaccactggcttcaaattctcaccgccagcacagcagtctggagtctatctgggacgattgagtttggtgggggaaggggataccgccattattgtagttttaggaggctgttttcccctgacagtgctaaggagactgggaggtttggaccttgcagcgcagcaaagaggctgtggccagactgcttctctagattcctcctcactgggcagggcatctctgcaggaaatccagcagctccagtcaggggcttacagacaaaactctaatctccctgggacagagcacctggggggaggggcagctggggtcacagcttcagtagatttaatcttcctgcctgccagctctggagagagtggctgatcctgacaagggggattctcccagcacagtacaccagttctaagggacagactgcctccttaagtgggtccctgacccctgtgcctcctgactgggagagacctcccaacaggggttgacagacacctcatacaggagagctctggctggcatcaggctggtgcctttctgggatgaagcttctagaggaagaagcgggcagcaatctttgctgttctgcagcctccactggtgacaccgaggcaaacaaggtctggagtagacctccagcaaactgcagcagacctgcagaagaggggcctgactgttagaagaaagactaacaaacagaaagcaacaacaacaacaacaacaaataacgccccaataagaaccccacccaaaggtcatcagcctcaaagatcaaaggtagataaatccacaaagatgaggaaaaaccagtgcaaaaatactgaaaattccaaaatccagaatgcctcttctccaaatgatcacaacacctttccagcaaggccacaaacctcaatggagaatgagattgacgaactgacagaagttggcttcagaaggtgggtaataacaaacttctctgagccgaagaagcatgttttaacccaatgcaaagaagctaaggaccttgataaaaggttacaggaactgttaactagaataaccagtttaaagaggaacataaatgacctgatggagctgaaaaacacagcacgagaacttcgtgaggcatacacaagtatcaatagccaaactgaccaagcggaagaaaggctttcagagtttgaagaatgtcttactgaaataaggcatgcagatgagattagagaaaaaaaacaatgaaaaggaacaaacaaagcctccaagaaatacaggactatgtgaaaagactgagcctacaattgattggaatacctgaaagagacaaggagaatggaactaagttggaaaacacacttcaggatattatccaggagagcttttctaacgtagcaagacaggccaaaattcaaattcgggaaatatggagaacaccattaagatactccatgagaagatcaaccccaagacacataatcctcagattctcaaaggtcgaaatgaaggaaaaaaatgttaagggcagccagagagaaaggtcagatcacctacaagggaagcctatcagactaccagggaatctctctgcagaaacaccacaagccagaagagagtgggggccaatatttaacattcttaaaggaaaggattttcaacccagaatttcatatccagccaaactaagcttcataaacaggagaaataaattcctttccagacaagcaagtgctaagggattttgtcaccaccaggcttgccttgcaagagctcctgaaggaagcactaaatatggaaaggaaaaaccagtaccagccactgcaaaaacataccaaaatataaagaccaatgacactgtgaagaaattgcatcaaatagtgtgcaaaataaccagctagcatcatgcaaatcaaaaccacaatgagataccatctcatgccagtcagaatggtgattattaaaaactcaagaagcaatagatgctgaaaaggctgtggagaaataggaatgcttttacgctgtcggtgaaaacgtaaattagttaaaccattgtggaagacagtatggcaattcctcaaggacctagaaccagaaataccatttgacctagcaatcccattactgggtatatacccaaggaatataaatcattctactataaagacacatgcacacatatgttggaataagtaaaaaagctaaataaactaaaaaaatcaatgttaaactctttttaggtaagtagagaactgaggtagtggcaaatcactgctctaaacatagaggagatggatggagcatcacattttctgttatcagaaacccaggaggaaaaattttccaggaaaccagtattgaagtagaaaaatctgaactgtaattgatgaattgctggaggctcactgtggacaagttgagagttaaaaattcagatgaactgttatgtcacaaaaagatagagtttgaagagataaagcaagcatcagaaccagagtcagatatggtagggatgttggaataatcagacaaggaatttaaaacatgtatgattgatttgataaggactctaatgcaaaacatagacaacgtgcaagaagagatgggcaaaataagcagagatattgaaattctaagaagggattagcaagaaatattacagattaaaagccatgtatcagaaataaataatgtcattgaggggcttattcgtagactggacacagctgaggaaagactgagcttgaggttatatagttgacatctgtagactacttcatgcaacaacagtagaataaaaattcttctcaagctcacatagaacattcactaagacagaccaaactctacataataaaacacaattaaacaaatttaaaataacaaaagttacgaaatctatacactcaccacattggaattaagttagaactcaataactgagatatggctgaaaaatccccaaagtgtggcgattaaacaacatattttaaaataaatactacctgagtaaaaaagaaattttaagagaaattttaaaatatttcgaactcaatgaaaatgaaaatacaacttgtcaaaatgtgtgagatgctgtgaaaagaatgcttaaagggaaatttatagcattgaatgcatatataagaaaagaagaaacaactaaaatcaataatctaagcttttacctgaaactagaaaaagagtaaattaaatgcaaaataataaaaattataaaaattagacaataaggaatgaaattggacacaaaatatcaatcaataaaatgaaaagctggtgttttaaaaaggtcaaaaagttagcttaagtatgaaaaaagagaagggatacaaattactaatatcagaaatgaaagataggacatgattccaaattccatggacattaaaagaataataaaatagtatgaacaactctatgccacagatttcacaactgagatgtaatgggccaattctttgaaataaacaatttactaaaactcacataagaagaaacagaccaaccgaataggcctatgtctcttaaacaaattgaatcaatatttaacaacttttcaaaacagaaaccaccaggccttggtgtgttctttgataagttatatcaaatatttaagaaagaaattgtcaaccctcaaaatctgagacaggtctgtcaattttggaagtttattttggcaaaattaaggacgcgcctgtgacgcagaatcaggaggtcctgacgacatgtgcccaaggtgtttcgagcacagcttggttttatacattttggggagacatgcaacatcaattaatcaattaacatatgtaagatgaacattggttcagtccagaaaggcaggacaacgtgaagcaaaggcaggacaactggaagttgggaagaggcttccaggtcataggtagataagagccaaattatctcattcttttgagtttctgattagcctttccaaaccaggcaatcaaatatgcatttgtcacaatgagcagagggattactttgaatagaaggggaggcaggtttgccctagcagttcccagcttgacttttccctttagcttagtgcttttggagctgtgagatttattttaattccacaaaattttattaattctctacaatttcttccagcagataaaagaaggggtaacacatactaactcattccataaggctgacattaccttaatactcaaaccagacagacattacaagaatggaaaactacagaccactatcaagtcattaacgtatatatacacacatgtatatgctaaacaaaatattagcaaatcaattccagcaatgtagaaaaagaactatatacaacaaccaaatgggatctactacagttgtgcaaagcagaattaacatacaaaaatcaattcatataatccattatagcagcaggctaaagaagaaaaatcatatgaacatatcaacagatgcagaataagcatttgacaaaatttaacacttattcatgatttttttaaaaagcactgagtaaactgggaatagaaggggacttcctcaacttgacaaagactatctacaaaaagactagttaacatcataattaatagttagaaaaaagagtttctcattaagattaggaacatgggaagaatgtcctcttccccaactccttttcaatatcatactgattgtcctagttaatgaaagataagaaaataaaataaaacatttacaaactgaaaagaaataagtttatatatatgtgttgaaacctatagaaatatataagacaaaaagtgaaccctaatgtaaactggacttacgcaataatgatgtgtcaatgtagctttatcagttgtagcaaatataccatctggtatggaatgctgatatctggggaggctctgggtgtatgggggcagggtgtgtatggaaattcttttaactttctggtcagtttgtctgtaaatctaatatcctttaaaaagtaaagtcttttcattaaaataaaaaacaatcctacattactttattggtgaattctaccaagcatctgaagaaaaattaataccaatacttgacaaactctttcaagaatcaggagaaagggaatagatcccaacttattttatgaagccagtgttacctgtatgtatacataaaagacatcacagagaaaaagctgactaatatcccttataaatatagatccaaaaatcctaaacagtatattggcaaactgaattcatcagtatttaaaaagcactggtcatggagttacgactaagtaatatttcatccaggaatgcaaggttaacttactatatgacaatcaatcaaaggagctgggtgtggtggcacatgtctgtagttccagctaccgaggaggctgaagcaggaagattgcttgatcccagcagtttaaggctgtagtgacccatgattatgggtcactgtattttagtcgtggggacagggtaaaacagtgagatccttactccaaaaaaaaaaaaaaagaaaatcaaagtaacatagttttattttatatattattttattcatttaagtattcataattttgttattttatattttattatttattaatatgttcaagagaataaaggagaaaagtcacaaaacatctaggccggtagcggtggcttgtgcctgtaatcccagcactttgggaggccaaggtgtgtgggtaacttgagatgatgagtttgaaaccagccaacatggcaaaaaactatctctacttaaaatacaaaaattagcaggatgtggtagcacacacctgtaattccaactactcaggaggctgaggtgggagaattgctttaacgtaggggatggaggttgcagtaagcagagatcccaccactgcactccagtctgggtgacagagcaagactccatctcaaaaaaaaaaaaaaaaaaaattcacaaaacagctaaatagacacagtacaatcatgaggtaaaaaacatttcttgataaaaaacatttaataagctgggaaaaatgagcttcctaaacctgatgaagactatcaacatataacttaaatttaacttcatacttattgatggaagacttgaatcttttcatataagattacaaacaagacaaggatgcctgtgctttctactattttatgttgtactggaggttctaggcaggacaatcaggaaagaagaaataaaagtaatctacattggaaaggaatctattcctctttacagatggcatgataatgcatatggtaaataagaggaatccactgaagttttcaaatgaataaatgcattcaccaaggcttcaggatataacataaatatacaaaatgacatttaaaataactacattcacaataatatcaaaaagaataaaatatgaataaatttaacaaatgaagtacaaaatatatactctgaaaactgcaaaatattgtgcaaagatattttggaaacctaaataaatggaaatacatctcatacgatgaatagaaagacttaatattataaagattgcaatactgaacaaattgatctacagatcaacataaatcatcttaaaacaccagaagactcctttgcaggaattcaaaagttgatcctaaaatttataacaaaatacaagggaacaaaaatagtgaaaacattcttgagaagaacaaaattagaagaatcacactgattttaaagactaaaagtctactggaatcaagacagtgtggtactggcatagggacagtagaagagaattgagagttcaggaaaatatataccaaacccctatatttatggtcaattgcttttcaacaaggatgccataaaaatttaatggataatgattaatcttttttacaaaattgtgctggaacagtaatcaatatacaaagaaaaaaagaagattgacttctacctcataccttacataaaaattaattcaaagcagagacctaaatttaaaagctaatttttttcattaatgttttctaggtttttaatgtacagatctttcacttctttggttaaatttattcctaagtaccttatccttttttactttattgtaaataggattattttcttaatttcttactttggatatttgttgttagtgtataaaaatgtacctagtttttaaatattaattttgtgtcctgcaattttattgaatttatttataggttctgagagttgtggggatctgtctatgtatatagtttttaggattttatatatataaaataatgtcatctgcagacagataattttactgattcttttccaattttgatgacttttatttctttttcttgcctaattgctctgtctaggactttcagtactttgttgaataaaagtgataagtgaaggcatccttgcctttttcctgattttagagaaaagctttcagtatttcatcattgagtataatgttagctgtgaaaaattcatatgtggcctttattatgttgactaaattcttttatacctagtttgttaaaagtttttaatcatgagtgttgaattttgtccaatgcttttcctgcatccactgaaatgatcatgtaatcttttctttcacttcttaatttagtgtatcacattaattgacttgcatatattggactatccttgcatgacaggcataaatcccacttggtcctggcgtgtaactgattcttttaacatgctgttaaattttgtttgctagtattttgttgaggaattttgcatatatgttcattagggatattggcctctatttttcttcttttttttttagcatctgatctggattcagtatcgggtaatgctgaccttaaaaagtcaggttgaaagtgttcctttttcttcaatgttttgaaggaatttacgaaggattggtgttaaatctttcaagtttttgatataattcaccaatgaagccctcttgtcctaggcttcccttttttggaagtttttgattactgatttaattttattacttatttgtctgttcagattttctatcagatctcaatggcattttttataaatgaaaaaataaatttagaatttttatgaaatagaagcaacctaggtgaccatcatcagatgagtggataaagaaaatatttattttctttatctatatggtatatacacagtggaatactatccatctttcaaattaggggaaatcctgtcacttgtgacaacatggataaacctggaggacattatgttaagtgaaacaaaacaggcacaaaaagataaataccaaatgatgttatttatatgtgaaatctataaaagttgaactcatagatgtagagagtagaatggtggttataagaggcagagggaggggagtggatgaagaaaggtgagatgctgatcaaagcatacaaagtttcagctagagaggaggaataagctctagcactctattgcatagaaggttaactgtaatatataataatgcattatatatttcagattgctaaaagagtagattttgtgtgttttcaccacaaaaaataagtataggacatcataagcttgtcaattagcatgatttaatcattctgcattgtaagcatatatcaaaacatcacattgtatcccacaaatatataattactatttatcaattaaaaataaaatttaaacaatcatatggaaccaaaaaagactatgaatagccaaggcaattctgagagaaaacaaagttggaaacatcacacttcctgatttcaaaatatattataaagctacagtaattaaaagagtaaaacactgccctaaaaacagatacagtgaccaatagaacagaatagaaagtaagaaatatactcacacatataacaccagatgctctttgacaaagtgtcaagaacacaatggagaaagggtagtttttcaacaaatggtgttgaaaatactggatatccagatgcaaaaaggtaaatttgggcctttatcatatgtgatactcaaaaacctacacgaagtgaattaaacacttaaaggcaaaatctgaaactgtaaaatttctgtaagaaaactaaggtaaagcttaatgacattgaatttggcaatgatttcttggctatgacaccaaaaacacaggcaagaaaagcaataaaggagaagagggattacttcaaactgaatagcttctgcacaatgaagaaaacaatcaacagagtgaaaaaacaacctgtggaactggataaaatattttcacagcatatatttgatatagggttactctccaaaatacataaggaactactacaactcaaaagcaaaaacaaataaacatgcaaataacccaatttcaaaatgggcaaatgatttcaatagacgtgtctctaaagaagacttacaaatggccaaatggtatgtaagaagagactcaacatggcaaatcatcaagaaaatgcataggtaaactacaatgagacaccaccttactcctggtagaacggctataatcaaaaagatgaaataaatcttggtaagcatgtgtacaaattggaacctttttacactgtcagtgggaatgtaaaatgtgctgccattatggaaaatagtatgaaggattttcataaaatttaagaaataattactatatgatctagcaatcgcactcctgggtatatatgcaaaagaatagcaatcaggatcttgaatggatagctgcattcccatgttcattacatcagtattcacaacaaccaagatatagaaacaacctgagtatccattgatggatgaatgcataaaaaactgtgttatatacatacaatggaatactatccagctttaaaaaagaaggtaatcctgccatttgtaactacatggatgaacctagtgggcattatgataagtgaataatcacagaagacaaatactgcatgatctcacgtatatgagttatccaaaatatgcaaacttacagaaacagaggatacactaattgttgccaagggatgaggagaggtggaaatagggagttgctcttccacaggtatgtagttttagttatacaagacgagtaaattctagagatttgcagtaaacgttgggcttatagttaacaaaattatattttgcacttaaaagtttgtcaagaggatagatttcatgcagtgtgttcttacgacaatttaaaaacaaaactaaaagaaaataaaatggttctgtacatgtcatccacattaagaaaataaaatttcctctcaaaatgaaataaaatgaaagttaatgctatataactcttaggaaaaaaattaaaagtaaatttttatgactggattacataatgtccctagatatggcaccaaaagctcaagcaacaaagaaaaatagatgaactggaccttatcaaaactaaaaatatttgtgcttcaaaagacatcatcaaggaagtgcaatgttaactcactgaatggaagaaaatatctgcaaattatatgtcagataagacacttgtatccaaaatatatcaagaattcttacaactcaagataaaaaactctaatcaccctattaaaatatggggaaatatttgaatagacatttctccaaagaggatatataaaaggtcaataagcacaagaaaacatgttcattatttttaaagaaacgcaaatccaaactgtaatgttatatcaacttcataccactaggatggatacaatatttaaatttaaaaaaaaacatagatggtgacagatactggcaagcgtatggaaaaattggaaccctcatacaaagatggcagtgattagtgtatcctctgtttctgtaagtttgtatattttggataactcatatatgtgagatcatgcagtatttgtcctctgtgattagattattcacttatcataatgcccaccagtttcatccatgtagttacaaatggcaggattaccttcttttttaaagctggatagtattccatagtatgtatataacacagtttttatgcattcatccatcaatggatacttaggttgtttctatatcttggctgtcgtgaatactgatgtaatgaacatgggaatgcagctattctttccagatcctgattgcaattcttttgcatatatacccaggagcacgattgctggatcatatagtaattatttcataaattttatgaaaatccttcatacttggtgtctaaacaccaagaagagttcagctgggctggttggagaggagatcaccccctggactgccaaactccaaacaccaggggaagatcatcttcctactacatcccttgctaagggatgtaaattgttcagtcaccttggaaaactgttttgcagttgctcaaactatcagacatgttaactttttgatacagacaggagacagggaaatactgggtaaagagtgtggttccctgtaaaggccccacactcaagcctggaaacctgcagccctaagcgggaaaaggcattcttgttttcccacccaaaagttgccttttggcccaccatgcccctctatcctgtacccatgtaaaccccagaccccaggctccagaagcagatgaggaagagatgaacggaagagcagaggaatggcagaacagcatggaagagggaaatgaaggagtgtctgaacacaaagaagagttcagctggggtgtttggagaggagatcaccccctggactgccagactccaggggaagatcatcttcccactccatcctctttcctgctcctcatccatcctgctgagagccacctccaccactcagtaaaaccctcacattcatccttcaagttcatgtggaccttatttttcctggatgctggacaagagcttaggatacataaagaatgctttcatactggccctctgctcttgtgaaaaggcagagggtccactgagctgtctaacacttaagctgtctacagatgacaaagctaaaggagcacactgtaacatgtgcccacttgggtttgggagtcacatactcccatccctggatgctgctgtggggtcagagcccagggaaacttgccctggctcctgaacctgcctgcctgcgtgttctccatcgtttcaggggtttgagcatgcatggcaatcgaacaagacgaggcacacccctgcaaggggaatcagggaactctctcgtttcattaagacttgcaattccactactaggtataagaggatgaaacatatgtccacacaaatacttcatatcaatgtttatagtggcattatttataataaccaaaaagtggaaacaattcaaatgtacttcaaataaggaatggataaacacaatgtagtataagcatactaaggcctattatttggtaacagaaaagagacttagtgatacaaactacaatgtggatgaaccttgaaaacgttatccgaagtgaaagaagtcacacataaaaggccacatattgtatgattctattgacatgaaatgtccaagtgacacaaatccctagggatggaatgtagattattggttttcaggaaactgttgcaaaagaaaggtggaataactgctatttggcaggaggtttcatttttaggtgttgaaatttcttagaatttttagtagtaaaagttgcataactctgtgaatttactaaaaacactgaattgaataaagagataaattttatggcctgttaaatatatttcaacgcagctgttaaaaagttaggaaaaattactcaaaggaaattaagaaagctctctttcaccccaggagcatttctacagttccagacatgcaatttctgctttaaacatctgctagtaaagtatttgaatacttgaagttcaaaaggtcaattccacagctatataaaggcagaaacagctggaaatagatgtcttcaattttattgaaaaggtaatgttaattggtattgcaaatatttgaatcagagaaaattgtaacaaatcaactagttaactgtgtaaaatatattgctacctccataatgtaagaagatttttaaatatataatttctattatctgatttaatttttctatttacatttaattttgaggtttaaaataagaagtgaacaattgcaaatttacaatcaagcaaataaaagttttcctttatttgtgccacaaaacttagcttttattattaaagatttccatgctttttaataggaaacatcctacaatgttgtttttatttacagccttatataaatataaaacaaacaatggagatataaagatacccattttggtagaagcaaaacaaaacccacattttttaataaaatgaaagaacagatatctgtactgttcattcatactacagtctcattcattctaaaattttatgaaaaatacatctgtaacctcttttgattcagaaaaacagaattcatttgcctaagttgaatgtgtggtttcctcagagcctccactataccataataaaagaataatgaagaaaatattgctatcctaaaaactgagctcacttccttcttttggggttgatcgtggacaggagcattttaatatcctaaaatttgctatgaaagaaaccattttccaggcttaatgggcatacattttgaatatcagctaatattctcagcaaggaagagcaattggcgaatttgtggcttatacttctgcttatgtttttatacaaagaactaatactagtttattggcctttatgccctgatcacaggtattagcatatgaaagtggtgaataatcttgacttcctgatgtggaatacaactggtgaaattcaaacctacttgtgaaattcaagaactgtttcacagatcaatcaccagtaatggcctgtgcatgtgcaacctgttacttaaacaaagaccgtgcctgcagttgaaaatgtaagcagaggatttatgaatttttctgctacttttcttactgtagacttgagctgttctcctggactcaattatggtatgtgctgaatagttaatactctaatataccaccaaacacagtctagatacttacagtcccataaaacgtaatgcttcaaaaaccaatgacataattgatttcctgactttatactgacttcattctctaaattttggggattcatatacaatctgatgatcttttgcatctgttttgcagacttaactagaattaggtttcagagaattcggcaatgtgactaaattttggagttattctctttttgatcattaatgctctatcccctgttgaaaggcagagtttactgcattacaagataattacctttagagggttttataaagaagcaatattttctagcaggaagttagtcactcctttcattaatacaataattaggaataatatgtcaagtgcaagattctgttgtatgaataactcttgttatgtggaatcattctagcctaaagaatagttttatgtataactttttattttcctttttatatttgctatattctgcccaaatagcattaagataggagagaaaaaggtaacacagagaggaacttcaggctatagtaactctttcactatttttgcaatttacgattccagtattaattgcaaaactctctctggagtcttgctctttaaagtaatatttgtggaccagcagcatttgcacaccctggaggattttaagaaacccagaatttcagatttgacctcagatgtactgaatcaaaatttgtattttaacatgatctcaatttataatattaaatgacaaacaccaatctacacatgtctatgtgtgtacatacatgtttgtatatgtatgtacatgtatgcatgcgtgtacatatattaattgcacccatttccatttctaaagataacttttcaacacaaacaataaactaacagtgtggggggaaagttcaccataatacaagaaggcaacaaggaagagtgtggctatcctcaccttctggcatttagaggtctctataagaaggctttgtgttgaagctatgtataaataagtgtgctgcttaacacaagtttctggggaacactatctcctttatgacactgtcttggggcattgttgagagagtctcagttttatatgtttcatctttataaaagtcaaacaggtggacgcacgatgttttttaactaagaattgtgaatctaagctttaattccctagttttcacttttaaaaagcttcaagtccccactctctggagtctcatctttcatacactatttaaataatggaatctaagtaacatttaaacaacactaactaagctattttataatatttattgaaggaaatatttaattatttcatgaatagtctgtttgatttatctgtattggaagtagatttacatagctcaacaccgattgcatatgtagtataaacagatgtaatgaaatatatgaaggtcctggaacatatgaaaacagtagttattataatgagtgtgcccatttaatatcaacaaaaagtctaaaatatattattatatggaatcaagattatagcatgactttattataaaattggctatgatatcaatgttttattaaatattgcttcagtacatatttgtaaatattttctccagttcaaaagctacattttctggttcacaaatattaatatatttgcttcttttacttctgttcaaaagtaagaacttttttaaaaaaaaaagtataagtaagcttttgcttaaaagtaagaacttttacagccattcatgactaagatttttaaaaactgagagcaataaatagtttctaggtgtattgatttcatagtaattaagataaaccactgaaccactgaagccatgcttccctctcattgcaaggagtaaagtagcaaattctatatttgagtaggcttcaaataaaactatttttgtaccttaaatttacaaaacatcttcagttggaaatgctaaggctttgcaaaaaaggaagaatatggaaacatacagaattcagccaggctataaagagattgatgaaaaacttagctacaactttgataatgtgtgtggtgaagatcttttttaatcaaatcagggaaaataattatgtaactgcctgaatggaggcattcatatctcccagtcaaacagaagtatactaaattgtatttggaaaacagagaaacacaaatttttcactgcaatcaagcgatgaaataaaatacttcagattttagtggtgttttaggatgtttgctcaaatcaaataattatatagccatatataaacagaaattgtgaaaatcaacattttataaacagtatggatctgtggttctctgatatcatagcaaccacaataatggcatatcatgtccatcagtgatgtagaaagaatcattctgacaggtgcattttgaattgaattgaaaacagcataatttccatcagttggcaaatgtattattatattgcacaacttcttcatgaaagggaattatacagacgaataagaagaattggcatagctctaatctactgacttgcagaaaaagccatgttttatttttaagtgacaaaagcaaatttcagagtaatgcgattaagatgatgctattcacgcgcaaacaacaacaaaaacaatatacagaagtttaaatgtatatgaaaaaacactatatgtatgttatgataaatgttgattgtctatagcaggaatgagtgatcctacaaaattcttctgcttccccattttattagtttgttctcatgctgctgtgaagagatatctgagactgggtaatttataaaggaaggaggtttaattgattcacagttctgcagggctggggaagcctcaggaaacttacaatcatggcagaaggggaagcaaacacatcgtacttcacatggcagcaacaaaaagaagcaccaagtgatgaggggaaagccccttataaagccatcagatctcgtgagaactcactatcaaaagaacagcatgaaagtaaccacccccatgattaaattaccccccactgggtcttcccacaagatgtggggattatgggaaccacaatttaagttaagattttggtggggacacagtgaagccatatcattccgccccaggccctcccaaatcttatgtcctcatatttgaaaacataatcatgcccttccaacagtctcccaaagtcttaactcattccagcattaacccaaaagtccaagtccaaagtcttatctgagacaaggcaagacccttctgcctatgagcctgtaaaatcaaaagcaagttagttacttcctagatacaatgagggtacaggtatttggaaaatacacctgttccaaatggcagaacttggccaaaacaaagaggctaaaggccccatgcaagtccaaaatccaatagggcagtcataaaaccttgaagtcccaaaatgatctcctttgactccatgtctcacatccagggcatgctgatgcaagaggtgtgctcccacagccttgggcagttctgctcctgtggctctgcagggtgctgctccactcctcgctgccatcacaagctggaattgtctgtggcttttccaggtgtaagctgctggtgtatctactattctgggatctggagaatggtggccctcttctcacagctctgctaggcagagcccacttttcccttccattctgctctagcagaggttctccatgaggactctgcctctgcagcaaccttctgcttggacatccaggtgtttccatacatcctctgaaatctagaccaaggttcccaaacctcagttcttgacttctgtgcacccacaggctcaataccgcatgtaagatgccaaggattagggctttctctctctgaagcaatggcctgagctgtacgttggccccttttagccatggctggaactaaagcagctggggctcaaggcaccatgtccagaggctgcatagagcaggagggccctgggcccagccaagaaaaccagtttttcctcctacacctccaggcctgtgatgggagaggctgctgtgaaggtctccgacatgccctggagacattttctccatttgtcctggtgattaacatttggctctttgttacttatgcaaatttctgcagtaggctttaatttctcctcagaaaatggggttttcttttctgtaagatgttcaggttccaaatattttccaaattttatactctgcttcctcttgagtgcttggccacttagaaatttcttctgtcagatatcctaaatcacctctctcaagttcaaagtttcacagatatctagggcagggccaaaatgcagccagtttgtttgctaaaacatagcaagagtcacccttattccagtttttaacaagttcctcatctccacctgagataacctcagcctggacttcattatctctatcactatccacattttggtcaaagccattcaaaagtctctaggaagttataaactttcccgcatcttcctctcttcttttgagccctccaaactgttccaacctctgtctgttacccagttccaaagctgcttccatattttcaggtatcttcatagcattgccccactattcagtattaatttactgtataagtccattctcacgctgctatgaagaaacacctgagactgggtaatttatgaagaaaagacgtttaattgactcagagttctgcatggctgggcagacctcaggaaacttaaaatcatggtggaaggcaaagcaagtacgtccttcttcacgtgggggcaacaaagagaagtgccgagcaaaaggggaaaagccccttataaaaccttaaattcccaaaatgatctcctttgactccatgtctcacatccagggcatgctgatgcaagacatgtgttccctgagaactctctatctctcgtgagaactcactctcatgagaacagcatgagggtacctgcccccatgattaaattatcttccactgggtccctccaacaacacatggggattatagaaattccaatttaacatgagatttgggtggggacacagagccaaaccatatcacccatgtttaactaattctgacaaatacatattatatctgcaattcttagtagaaatataaaaattgttcttaaaattaaggtagtaaaaaataacccaaatttaatcaagattttacatatagctactagtttccaggaatgggaagaatttaaaaaattattaaaaaatactgctaaagtaaaagaaaacataaataaatgaacacatatacatgtttatgtattgagaaaataattattgttaaagcacccatctctgcaaatttatccataattgttagtgtgcgtacattgacaagccaattctaaagtgaatttggaaaataaaaattattgggtaaataatacaattttttaaaagaagaacaaagttggaggaatttacattgtctgtttcaatatttatcataattaaaatagtgtctttctagtgcaaggatggacaaatgaaccaatggaacagaagagagattaggattatatattcagttacatgttttatggcaaagatgttactgcaattcagtggattaaaacatttaataaatgatgttagattagttggatatccacatgggaaaaatattgccttacacaatacacaaaaatttattcacaatgagtcatactcataaatgatatgtaatataatgaagcatgtaaaataaaacatagcaaagatcttcatattattgatcaagatttttgaatgtgacaaatcaaaaaaatctataaagccattaaatccactgaaaagtaaaatcagagatgtgcagaagagtcttgctgtctatctatctatctatatataggaattttatacagacacataaagatgtcccataaattaatgagaaaaagatatataatataatgaaagcatctggattcctgttttctaccaagacagaataacagggataaacttactctcttgtgttaaacaattagataaatacaaaaaaactagaacacaaaatactaagctatatgaagcagctaaacaactaaaatatattacagtaaaatatatccccccccaaatttcagttttttgacaattaatgctggactgtggtatctaagaaaaaagaaagaaacaaagtaagccctcattgtctccaggaaccagcttagtgcctagagaaaatttctaggacacagaaaagaaagggacaaacagagaatggcggtctcactgaattgattaatcagagattgtacgtcaggaaatttagggtagctagaatttaggatcagaggactagaaataaagaagctgcacaaagggagagctcatgagatctgcagaaaagtctccttaagactaacaactagtctttggctaaagtctgttttgcaaattgatgtgagaaaagtactcaaggccgggagggaatcataagacagcaatacaaacaatttcagagattatttcgggctcaaaataattcatgttccactagccacagtggaatcatgacacacaaacacaaacaaaaagtcaatttaaaaaagatagaataggtagtataaagaaacaatgaagagatgggataaataggaagcaaatagcaagatggcacattttaatttgagtaccttttaatttaaatatactatctcattagatataattagtctacacactaccaactttaatgtaaagatatatacattagctaataatgaacacatcaagtcatcttatatgcatgcagatataagagtttcaaaatatatgtctaggaatggacaaaatctagcttatctgtaaaactgtatctacataaaaactttaacaactattatagttaatagagtgatattgaaagcttttcctttgaaatacagaaggtgtcaaggatgatagctatcactacatctactcaacatcaaacagagggtctttggcagtcaaataagttttatgaagaaaaaagatgtgtaaatatagtaaataaataaagtttgaattatttataaattataaggttggatacacataagaaattcaaaagtcaaaataaattaatagaattaagaaacaaatttagcaaagttgtttgtattaataataagtttagaataaaatactaaattaaatgtctatatccattaataattaattaggacacaaaaagctttcaagaaggaataaaaaatttatcaattgtttaggcataaacctaaaggaataacctgctaagttccctattatattctaagtatttattcttattaaaaagaaagaaactaaataaatgtaaggattcttcttgttcatgggttggaagactcagtactagtaagttgttcattctgccttcatttatctacagattcaatgaaatacctaactaaatcatgacaatctgggggaaaattctaatatatatgtcagaaataaccatgactatcttaaaaaatgaataaactatgacaacttattgtactacatgttaataattattatgtgataattaagattaatgataatcaaataaccaataaaacaaaacagtgcacccaggagcaggatcatccatttttgatttatgacatatttggtactgcagagctcgtgaaaaagacagttctttccaaaataaaattctatgtcaattaaacgtatctgtgaaaaatcttgacccctgttttacaccatacatatgtcagtttaaagtgtgttgtaaataaaaatgtgaagtagaaaaaaaataaagattctagaagaaaatatagaagaatatctttacgtcaaatacttgaacaagataaagctttttttcaaatggtaaaaagaaaacatgaaatataagagaaactattgatacattgttgtacaataaaattaagatattctgttaatcaaaaggcactagtaagagagagaaagacaaaccacagtgttgatgtacgtatttgtgatatataatacaaagtccttgcatacagaatataaaaagctcttacaaattatataagaaaataagcaagcacaccactagaacaaaaacagggaagagacatggataggcagtttaaaaatatagagatgcaaatggaaaaaatatataaagaagttttcgattacattattcatctaaaaaatactaatcaagagttcagtggtcgctagagaaatcaaatccaaaccacaatgtgataccatctcaggccacttagcatggcaatcattaaaaagtcaagaaacagatgctggagaggatgtgaagaaataggaacacttttacaatgttggtgggagtgtaaattagttcaaccattgtggaaaagagtggggcgattcctcaaggatctagaaccagaaataccatttgatccagcaatcccattactggatatatacccaaaggattacaaatccttctgttataaagacacatacactggtatgtttattgcagcactattcacaatagcaaagacttggaaccaacccaaatgtccaccaatgatagacagactggataaagaaaatgtggcacatatacaccatggaatactatgctgccataaaaaagaatgagttcaagtcctttgcagggatgtggatgaagctggaaaccatcattctcagcaaattaacacaggaacagaaaaccaaacaccgtatattctctctcataagtgagagttgaataatgagaacacatggacacagggaggggaacattacacatcggggcctgttggggggcggaaagcaaggggagagagaacattaggacgaatgcctaatgcttgtagggcttaaaacctagatgatgggttgatgggtgtggcaaaccaccatggcacatgtatacctacgtaacaaacctgcatgttctgcgcatgtatcccagaacttaaagtataatttcaaaaaaaaagcacatgctagaatgtctaaaattaaagacaaaagtgtcaggaaggatgtagtatgctgacacacttctgttgggactgtaaaattgtacagccactctgggaaactatttgaaattatttcctaatgttgagtataggtcaataaataggtaaattagcaaaagataagtacatagtagcataattagtagtaatccccaactgggaaaaagtcaaatgctcatccataattgaatacataaacaaactgtgatatactgaaaatggaaaattacaaaatgaaaataaatgaattacagatacacataatatgaacgaatctcaaaaacaagatttatcaaaagaagccatatataaggatacagactgtataatttcattgatgtaaaactcaaaagcagctataaatattgtgtgaaaactcgggttagctgttatctttagggaagggcaaagggtagtgattaggatggaaatagtaaggcagctcctgagtgccagcaatattccattgcttgattcaggagggtagtcatatagcaatttgcttcatgataattcattcatctgtacaattatattttataaactttacattatgcttattatacctcaaaataaagggttaaataaaaaattaaagtattatctgctttaaaataaatacacatatggtaagaaaaaaaattcctgttttaaaagcctggaaataataaacaaaatggaacagaatagagaacatagaaaaaaacccatgcacttacagaaaactgattttcaacaagggtgccaagaacacacaatggggaaagaatagtctcttcaataaatggtgctgggaaaactggatatccacatgtaggagaatgaagctagacccctatctctcaccataataaaacatcaatgcaaaatggattaaagacttaaatgtgagacccaaattgataaaaacaccagaagaaaacaagggaaatttttcatgactggcctgaatagggattttttgaaataaaccgaaatagcagaggcaacaaaagcaaaaatagacaaatgggattacctcaaactaaatatcttctgcataacaaaggaaacagagtgaaaaacatccttcagaatgggagaaaatatttgtaaactatatatctgacaagaagctaatatacagaatacgtaagaaactcaaacaactcaactccaaaaaaaaaaaaaaaaaaaaaccctgaagagaccgttctcggaagaaggcataaaaatagccaacaagtatgtgaaaaaaatgtttacattataattatcagggaaatacaaattaaaaccaagttaagatatcacttcaacccaattagaatggccattaccaaaaagaaaaaaagtatcaaatgctggtaccaatatagagaaaggtgaactcatatcctgttgatgggaacataaattagtatagctaatatgaaaaacagttcatcacaaattaaaagtagaattgccatacgatccaacaattgcactattgggtatatatgcaaaagaaatgaaattagtgtatcaaagagctatctgcactcccatgtcttttgcagcactattcacaatagctaagatatgaaatcaacctaaatgtccatcaacagatgaatgcataaaaaaatgtggtatgtacacataattaaatactatttggccaaacaaagaatgaaatcctggcattgtggcaacatggatgaatctggaggacattatgttaagcaaaaaaaaaaaaaaaaaatgccaggcacagaaatacaaataccacttgatttcactcatatgtggaatctaaagaagctgatctcataaaggtagagcatggacgagtgggtaccagaggctgaggtggccagtggggagggagagataaggagagatcttgtcaaagggtaaaaagttacagttagataagaggaatgagttctggtgttctattattatattacatgcatgttctttacagatacagctgcaaagactgcaacctcctattgttaatttgtgcactcccactaaaaatggatcatctgggccaggtatggtggctcatgcctgtaatcccagcatttggggaggtaaggcaggcggatcacaaggtcaggagatcgagaccatcctggacaacatggtgaaaccctgtgtctactaaaaatacaaaaactagctaggcaaggtggtgcgtgccagtaatcccaactactcaggaggctgaggcaggataatcgtttgaaccagggagtcagaggtcgcaatgagccaagagatgctgccactgcactccagcctagggacagagtgagattctgtctttaaaaaaaaaaaaaaaaaaaaaattcatctgattgtaaattccttgtaagtaatctagcagaggtagtcataaaatcacctccataattctgcttccactgcaatgcactgagtcattggaatggctattttctttttatgtaaaaataattcctgatacttttatgaaaaaattataatcttactctttcatctcatgtttcttctccttgtaaatcctggagaatagttaacacatggacatatcacagcaggagagtagtgcatacatggggatcatttagaagagactgatatttagaaaaatgctttagaggcagcctgacttaagaagtgcaagactgctatgaatagtcaatgaactcctataaatgtagagcccatgtcttgatcattactttctttatagtacttggccacaatacttagcacacataagaattcacttagtgttgaatatattaatgaccaagagataatgttcatttagtacatcaaaacttggcttgtcctacctcagttgtgggaataagtaaaaaccacaccagcttaaactgcaaaaagcaaatggcttgaccttctttgatcttgtagactccctgaaaaataactttgcatgactgcaactgtcttctgaaatgattggctaacgctctaaattcagaagacttgaactttttacacaaaatttaattttatgttgttaatctataagagttaatcccctatttcataaattttataataaaatttttctacatactcatcaaattaaattgcatactttctaattattgccatgctttcaaatgaagttgcataatattttatgcaaatgataatgggactaataatcaaaagagccacattctatcaaatcctgccatgaattcttaagaaaatgagtttatttgcctgggaccttagtctgtgtttataaaataaataggttaaagtcgatcaaggttttctaaagtgatttttttaaagcctcttaaaagttcacaaaatcaattaagtggttaacatcagcatttcagcatttttaaaataagatggaagggaaggaatattattatagggtatcacatataaggataaataaagtattatgagaattatttgcaaattctaatgtgtgccagtgtgtatattgcattgtgatgaaacatgcctttactgtggactctattttttttaaaaaaggcactgggccagccaacttccaaagttgaccaattccgatttgcagattctatcagttttaatcaatcaaatcatttttgcttcattcatcttataaaaaaacataagataaattatcatatgggaagatgtacaaatgttgacaccaaataatgtaagacactaataactttggattgctagctatcaataataactttgtgtctttagacatttatgttcccagaacactgtgatattccattcttgagatactaatttgctatttgttgtgtctaccggttcatttccctgtgtaaagtataatattgttattattgggaggtcatctttatttgaaagtgctttcacaagcactttctttgtctgccttgactctggaggaggcaatgactataatttcacttatattttctttctagattccaattccttctacatattgatagtttctcacaggtaacccttgtagcataaaaataacaaactgctgtgttaattcctgagaagaagcatgaagtatttctatcccttattcaaagatgctgcagcccattggagctgcaagttttatgttagagactccctttcagatttcttgctttcttggaaaccagggcaatacttcaacccccaggtacctgggtccttacttaaaaacaaaacaactgagccctcagttttggcatccttgtctccactttctgaattggttttgattttgctcctttttttctagcacttaaaattctacattaaggaaatttttttcttttgaaaatcatatttatttagaatttctgtgtctgcatcagttgtgctactctgccatatcagctcaagtttccttaaggacaaacgtcaatcttcaagatttttttaagtgaaggtttcattactcatatctactttttgaaaggtgactcacttccagttcaagaagaaggactagattggttgtctctacttcccagcataaattcctcatgaaaaaagaatgtattgttaaagtacataattatcaaatggaaaaggcccaccaagtcccagttaggataaatgaccaaggaccattcttagactatcagggcaaaatttagaaccctggagtaaggaagaaaaattataaaagcttcctaatgaaaagtaacagactatttaaataacaaaaaatcagattcgtctcagctttcttatttgttacattgaacgtaagatgacagtggaatgttgtcttcaaagcaccattgtaaaaaaaatgaagttaaaattttatacatttatagatataatgaaagctaatctatcactaatttgtaagggagaaaatacagatcttcggaactgcaaagacaatgaacatttaagcattactaacggatgtattttagcaagaaaaatacattcagtaagaaatgggatacaggaaataaacactagggaaaaaatacctactattacatgtaaaattgatgcttaaaaataaaagtttgaagctaaaatctcaaatgatatttttaaaaattatgtcaaacttattttttcatccaaagagaatacacatcagtcaaaattaggttgagttgcacatagcagtaataagtaattccaaaggacagagttatctttctcatgtaaaataattgtcttgaggtaggtgatccagtgctaatatgatgactccactattatttatgtaacatttatattaaacatttaatatttaaacatatttttccatcaacatggaaaattaatcagcaactataacatttccttccaaataaaaatgctttttgcaagctgtcactttcttcctcttccaatatcccatattttgttgaaatcttctggagttttaatatctggtttttattatattttcaatatgcttctactttcatagatgtaaattttatagattgtcttaaggtttacagccacaccttcaactattaaatatacttaactataaattttgctggtttatttgttcaacaccgttttacatattttgaaagttcaatagttcttgaactcaatttttttttatttggtaggaataactaatttggtgtttcagaaagactttcgtatcatcctgcaaattggaaaatgtcatgagcttattctcaaaagcgaatgatatttttgaaggacatagagttttacatttatacttttatttagaaatttaaaaatatttctccacttttttcaaacaccctgagttgcaaaatataaatctgatgccagtctaattctaatccttttcacagtaatcaagtacacttgattgtttacttttgtttgtctcttttctgcagagaaagctattatgaagcttttaaaattctggaatacttaaatttctacactaattctctaggtccttccccattaataccaccatgatcttcagtacttatgggactgttttcaaagcttaatgctttaatcagctcagaaaaattttatttttgcatttcttcttttgcatgtcttttactttctttttctacaactcctattggataggttgtccaaatttaatttagtaatctcatctctttatctttttacagtacatttaaacctaagctattgactccatgtaccaatcaaagattcagctttcagctgtttactctaatattgagtctgttcaatttttttctttgttgtataattacttttaaaatttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaatttcacccacgtttttatttttcattgctctaattgtttcatttttatatgagaggagcatataagctaaatgcacaatttaaataacagtggctttgattaaacaaagtacaaattttattttaccaaactttattttaccaaataatatattccattttttaaatcgttaattgaaagtatagcccagacttcctcacttctttgaaatgctatctttaccaattactatattttaatgagccagggacttgggaaggactttttttgctgttgcaattatgtatatacctatccttgcatcagtgatccaatacttgaattatgacaggtttataatgtaattaatacccatacaaaaatattttttcagcattttttgctattttcaccccttacctctatcctcatatctaaattattttcagttgaactcttgaggtttctgagtaattatatcatctttgtataaatgtcgtataatttttcctatagcatacaaaaatcattataccctccactgtagttgtaataatgttttttttttttttttgttccctagatcctggcttcaataggaagacctttgattctttatcaagtactcagttgtatcttcttaagaaacattctcttcacttttaagatctttctattcctgattcgaggtaaatttgttttctttgtttctctttgttttttaatctggatacttgttcacactccatagagattatcaacattatttctcttatgaaatatagatatatgagttatattattatactttttaataaaaaccatttttcataattttaataaagtttaatgtagtttctttggtcacaacttactatatattatgggtataaattgaccttaatttactgctgatgttctttatctttacattcagatatgtttacaaaataaaataatgagatcggtcactttttaatttgtaatacttgacatttaatttcacaattttttttttttcttttttgagacagagtcgctctctgtcacccaggctggagtgcaatggcatgatctcagctcattgcaacctccacctcccgggtttaagggattctcctgcctcaacctccctagtaggggggattacaggcgccagtcaccctgcccggctttcacaattttattagtatgagtaaaatgttcattttttatcctatgcaataatgtatatatatatgacatagaaattgtgtatttctttaaagttttagataccttaactgttggaattgttgaattttacgacttctatttaatattttaataattactatcctagaaaatatttcagagagcttattttaggctagagatatttatttttgcttagagtatatcttgaactattaaaattagattcttaattttctattttgtatatcctgcatatgtttgtgtataattattttacccaaaagtgaacaccgaatgatgaacaataaagtactcatttatatcctcttatgagtcttgctattgaatgttttatcagtttcaaaagaatttatcagtcaaggacaggactgttaaccatgtttatattcctttcattgattttcctttaattaatctatgtaccataaaattatttatatccctcatttctattttgcaaagggtttaattaaaatatctcaatattcttaagtttttttcttaaaaatcaccattatgaataaactttgagtaatgacacttccctaacctggaatatttgggattatttagcattgtttattttaatagcaaagcattacaaatagtgaaactgttgaactttcattccatcaccaatgatcaatcttaatatgtattccttaaatcatgttgctacctggctaatgagtatcatgtctttttacaccggattttattactacaaatctgttttcttatgtagtgtttgtaactattgagctgtacacagactaatattgaatagcttataaaataagactttaaaaatatttgtatcaatctgttgaattgagacattttctttattttgtagaatatatggtgctgcgagggcaacttttcaattctttagcatgcagacttttggaaaacttaatttcttaattgtaatgtaagctacatacttttggaaattttaatttttttatttcccacttattagttatgtaaagtcaacttttccatttttcaactgttctcccccatgtaaacataaatgacccactataagaaacagttttgctagttttatgagaaaaaccaacatagtatacacttttccctgccttagtagccaatttgaggaaagtaaatggccatagactccaactgatagatgcctcagacattcttaagtgcgtacttataagacaaatgtttaatcatatgttatttgctttcccataaaacgtttatacttcaacttgtacctcttgtaatgattttcttgggcaacactatggaatacttgtgagatctttttttttttttttttttttttttttttttgatacagagtctcgctctgtcgccccggctggagtgcagtggcccgatctcggctcactgtaagctctgcctcccgggttcaggccattctcctgcctcagcctccgagtagctgggactacaggcgcccaccaccacgcccagctaatttttgtacttttagtagagacggggtttcaccgtgttagccaggatggtctcgatctcctgacctcgtgattcacccgccttggcctccggaagtgctgggattacagacatgagccactgcgcccggccgtgaggttttaagatgctgaatttagactgaaataattatctgcaccatgcacaagtgggtcagccttggaagagaaaaattgcactgccagctttgagtaagaccctagaggcaaggaccagagcacatcatgtgggtcagccttgtttggttattttcaatgaagttcttcggctgttgttgcctaaatttccattaggttgcatcttttcctaggttaatagctttagatatgctcagtttctaaaggtaagtcctagacaaattttaaaatgtctacagaggactttcttttttttctttctttttttttttttttttttgagacggagtcttgctctgttgccccaactggagtgcagtggcctgatctcagctcgctgcaacgctcacctcccgggtcaaacgattctcctgccttagcctcctgagtagatggaattagaggtacatgccacctctaatttctttggctcggcttatttttgtatttttagtagatgcggggtttcgccgtgttggtcaggctagtcttgaactcctgacctcatcaaaactcattaaaagaattgtacataatcactctctaattcctcttctcttatccattccaaaacctgctgtacccaagctttttttctgtatattacaaacaaaattggttttgttaaaggtaaccaatgaactccatactgtgaatctcatggtgaattctgatttaccaagtgtcctatgtatcaggagtgtttgacacagcaaatcaatcattcaccttcaaacacttttttttcttactttacttccaggatgtgagtcttatgttcttgtattcttccctggaaggcttttggaattattatcgtctatgcctgaaattgtctcttcccattgctcactccctcatctcaaccatgtctttagttagatgctatcttctcagctaggcctacctggatctctctttaaaatggggttaaaattggattcagtgtatcaacaagccattgacaatctcacttactgggctctgtatttttgttttagtttcctgcctgcttccatgagaatataaaactccacaaggactgagatttttatctttttgctttactaatgtgctaccaaccccaagaaccactcatttcgtgtaaacacactcagtaaatacttgttgaatttaaatggttgctatttaagatttttttaatcatgaaaatgaaagtagttatatcttcacaaaagttatttaattggtgaatgaatcacaccaacttcaattttcttgctctcagatttctacgaattagttttataaggcttcaaagttagttacagatgttatcttgaatctgacctacatgagtgtagcttttcttgatcctttctcttgactttaactatatagtacttgcattgtttcacaagaaaaacaggacaattgtcacagaaagaaagaaaggcctcaaaataaaacagtcatagcttcttcatagaaccaccatctcatattttagtgcctatacagtttcaattagttttatctatattttctgattgatctccttctgcagtttaataagactgcataaggttcactgagttagaaagctttacaaaaataatatttacataaatctattatttcttgtgtggtggtggttacatcaaattatttccatcaaaggtcttcgtcattcccaagaatctatttaaaagaaaatatgtgtgtgtagctatgtatatgtggtaatgtagctatctagaaacagatacatgcacatagttaaattactttcacttttaggttaacttctcagaaaaattgctttgccaaataatctatttaaattgttaattttacgaattgcttacaaatgaaaatttctttggcattcacagtgaagagtcatagtgactatacagtagctatgaaatcttgattgggaatgtcaactttatcatgaaagaaactttttctaaagagcatagattgttgagaatgactgacttttccagatgcatatattgcttgagactggcaagacagtataaagaaaagttatttgactcttgtcagagtgatgaatttgaacaataaaaaggaaaacataaaagttgacatgggaaatatttggaaattttcagcaatctcgttaaaagtgcatgttgaacttcctagtaccttctgttttacattcatgtccacaggaaaagccatatttccatgtcaggcaaatgtatcagattaaaaacagttcatctacattatgtaaaatacatttttttcagcagactttgcttttccaaaactccttgccatttagttccattggcactgaaatgcttacgtattaaatgtctcataatttgaagggcacataactaaaatgatgcgtccatgatttactagtaaatttataaagctgactcaaacaatgttcctttgccaatgcaatacttatgccttagaattacttcagtttcacaatattttatcagacatataaagtaatgttctctagtgaattcctgaaagtgatttcctagactcttaattttaaattactttcactcagacacacattcccagacaccaagtacaggctatagttttgtttttcaatcagcccaagacaattttcaaaaagtgtgtcaataaactgttgagatctgagaaaaaataatacctaactagatcaagtatttacaaacatgagatggaagaataagaatggttaattctgcatacatgtatatatacataaaaatacgtatgtctataatctgactgctcccttttcatatcaatgtgctttcattacctaatctttcacgtcttattgtctttgttgtcaggcatttcttttgcaatgaaaatctgatgctcttgaaatttacttgtgattcatattattactttttttaaaattctttccactaacccattagagctatgcatattcttttcatttttgctgtgtaatttgttcaaagaacaggtcaagtctatttatccctaattgagaataaatctgtctgaggcagatgtttggcaaaagtagtgtgagtgggttttcgttaggtcttttaccgttcttagaaatgctgtcagcatctgccagtcagatcataaaccgtagaaccatgtgatgtagttctagattatcatttcaggaatcccacagctctggtggagtgaggagcaaggagctgggagcataagccatcctaaaagtgaggtctacatgatttctgtcctgtccggcatttgctaatgctgctgagccagggaccagcttttcatagttagttttcaatgtaccctaggatctacgctgggccccaccgtgcctgagactgactggctttctctccagtgctgttgcctctttaactgaagagttcctgctccattacgaaaggactgtgctccattgggaaaaattaaaatgtagtcattcaaagaggaaaatctgcatgtaaaaggaggctctgcaaccaaaagactctggatttgatgtagtttggtacagatttcaacaagtgttgagaacctccattggaaagggggttttaagtgaaataacaccttcacttaactagaacttcagtttttaagcctctaaaatgtaggataatcagcaaattctgccactatttttacctgtatttcatgaatttcatttattcattgctgtgttttattcattaagtgatttagtaaataaataattattaattgaattacaactatgttctaggtaatgcgatagtgagcaaaacagaccaaatccctgtcctcaagttcttgctttctaacaggaatgttaacctactttcttaggaaagaaagttataagtcaactataaattatgtcctttaatctggcaccaatttacctatatctagtaataaacagtaaaattttattcaccagacttttatattgttgtagtgataatgtgagagttctttctctttggttctttaatcatttaaattgtttgtggagaccttattctagaggaatggacttcaattttttcagaagggagaacaaatattatctgaagtaagtaaaatatgtaggatatatagagtcattttctggacttcactgggggaaaagttaactttctcttctcacaaaaaacaattctcacgctgttcctttcattttcctgtgacccctttttcttctctatggaatggcaattcctagcacagatcagagattaatgcagtttagaaaaaaataagaaaaagaaatattgaggcttaatgttttgaatataaaaataacaacattatattttctactaaaattacattaataataacataatattagaatatgaatcattttattgacaaatgggtctatagtataaatatgctaattgctttgataagatatatttcaacagtgctatgtaagaatagtgccagttcaatatatgagcattcactttcaaaaataacactgataattattggccaagtaaagttaagcatcaaaaataaaaactatcctgaaaaacataaaaattatttaccaaaggagaaaaagcaaatgcccagctgcaaaaaaatccattttacaggtccaagccaatgtcaacgctgagatctggaaattaaagctgcattatcttgaatcttttataaaagtgtcatgagacttctggttctgggatagactatatacaaattattttttaacttagacttgactcatctcaagacacagagttacctctcgttttttttttaatggaccatatttggcaaaatgaagaggaggcctgtgattagcatatcaaagacaaggaagtaaaatcctccagtgcgggatatgtagcatcaataaggaagtagcaagtacatctaaacttcacaaaaatcattagcagaacagaaataaatgggaagcaggaaaaccatcagtgtggtgactaagacaacttgctaataactgaggttgataaaacgcatatgtatagatgtaaactttgttttgaaaggaatttgggatgggggtgatttgagaaggaaagccccttgtcttatctattgtggattgaatctttcaaggtgaagctattttaaaaataaattaacatacgctgtattatttggataacagaatatttatgtaaagttactttaaaatgctttcatggccatcagctcacttgagagttttatgaggtaaggcaggaaaggcattattatcctgagattcatgaaagtgactgactgtctagcaagaattggaacagagatcccaatctaaaccttcactgcatcacaatgaaattttcctgatatggtttggctctgtgttcccacccaaatctcaccttgaattgtagtaattcccacgtgtcatgggagggacctggtgggaggtaattaaatcatgggggtgggtttttcccatgctgttttcatgacagtgaataagtctcattagatcagatggttttataaaggcaagttcttctgcacatgccctcttgcctgccgccatgtaagatatccctttgcacttttttgtcttccaccatgattgtgaggccccccaagccatgtggaactgtgagttcattaaacctctttccttttattagcaacatgagacagactaatacaataccttcatacatatgctaatgtgtttgtaaacttaatatgtaagtattccttgtatttggaaaacacccttagattcaaattactctaggagcaaaaatgataaaaaaatataagcaatattaggtattttggggatcttcatgagacctaaaacagtaacaactacctggaattgaaaacttaaccaggcaaaggaatcacaagaacaccaaagttacatgcaaactcacctcccttttcatccctgctcccctcaaaaaaatgaatccaatctttctctgacttattttttttatgaatacatactaaagacttatttattcctgtgttctaaaatgtaatctttttaatggtgtcttacaatctgaaacttgatgtgtttaagtatagaaacttttattttctaggataacttatctcctaacacttctattgttccctccttccctaattacaattagactgattttcacttctctaccccattttgtgtagcattttaacttctatttctacttcaggattatgcctcagctatctattttgagtgtctcactaaatttttatatatctgcttacatgctttaatttccagggctataatttactttttgattgcttctttgcaaaaacgtctgttcttattgcatgaatacaataactttcaatctttgtggggtattaattataaatatttgccatattctgcttcttctattattttttcttctttttgttaatttttgttactgtaattcgtacgtgaggcttttcttaaatgtatttgattttgtgttttgtattcatactttgtatcctgcagcacatccaaaagctcatccaccacgatcaagttggcttcagcttggcatgcaaggctggttcaacatatgcaaatcaataaacgtaatccattacataaacagagccaatgacaaaaaccatatgattatctcaatagatgcacaaaaggccttctataacattcaacaccttttcatgctaaaaactctcaaaactaggtattgatggaacatatctccaaataataagagctatttatgacaaacccacagccaatatcaatatatttgggcaaaagctggaagcattccctttgaaaactggtataagacaagggtgctctctctcactattcctattcaacatagtattggaagttctggccagggcaatcaggctagagaaagaaataaagggtattcaaataggaagagaggatgtcaaattgtctctgtttgcaaatgacatgattgtatatttagaaaaccccatcgtgtctacccaaaaacttcttaagctgataagcaacttcagcaatgtctcagggtacaaaaccaatgtgcaaaaatcacaagcattcctatacaccaataatagacaaacagacaggcaaatcatgattgaactcccattcacaattgctacagagataataaaatatctaggaatacaacttacaagagatatgaaggacctctttaaggagaactacaaaccactgctcaaggaaattagagaggacacaaacaaatgaaaaaacattccatgctcatggataggaaaaatcaatatcatgaaaatggccatactacccaaagtaatttatagattcaatgctatccccatcaagctaccaatgactttcttcacagaattagaaaaaagctactttaaatttcatgtggaaccaaaaaagagcccatatagccaagacaatcctaagtgaaaagaacaaagctggaggcatcatgctacctgacttcaaactacaccacaaggctacagtaaccaaaacagcatggtactggtacgaaaacagataaatagaccaatggaacagaacagaggcctcagaaataacaccacacatctacaatcatccaatccttgacaaacctgacaaaaacaagcaatggggaaagaattccctatttaataagtggtactgggaaaactggctagccatatgcggaaaactgaaactggaccccttccttacaccttatgcaaaaattaactcaagatagattaaagacttaaacgtaagacctaaaactgtaaaaaccctagaagaaaacctaggcaataccattcaggacataggcatgggcaaagacttcatgactaaaacaccaaaagcaattgcaacaaaagccaaaattgacaaatgggatctgattaaactaaagagcttctgtacagcaaaagaaactatcatcagagtgaacacacaacctacagaatgggagaaaatttttgcaatctatccatctgacaaagggctaatatccagattctataaagactttaaatttacaagaacaaagaaacaacccatcaaaagtgagggaaggatatgaacagacacttctcaaacaaagacatttatgcagctaacaaacaaatgaaaaaagctattatcactggtcattagagaaatgcaaatcaaaaccacaatgagataccatctcacaccagttagaatggcaatcattaagaagtcagaaaacaacagattctggagaggatatggagaaacaggaatgcttttacactgttggtgggagtgtaaattggttcaactattgtggaagacagtgtggcgattcctcaaggacctagaaccacaaataccatttgacccggcaatcccattatatacccaaagcattataaatcattctactataaagacatatgcacacgtatatttattgcagcactgctcacaaaagcaaagacttggacccaaaccaaatacccatcaacgattgaatggataaagaaaatgtggcacatatacaccatggaacactatgcagccataaaaaaggatgagttcatgtcctttgcaggaacatggatgaagctggaaagcatcattctcagcaaactaacacaggaacagaaaaacaaacaccacacgttctcactcataggtgggagttgaacaatgagaacacatggacacagggaggggaacaccacacactgtggcctgtcagggggtggggggctggggatggatagcattaggagaaatacctaatatagatgataggttgatgggtgcagaaaaccaccatagcacgtgtatacctatgtaacaaacctccatgttctgcacatgtattctagaactaaaagtataatacaaagaaaaattaagtactacaaaactgtttggtctttccacatatatgagtgatcatctgcactattcaacattgcactggaggcattagctggcaataagaaaaaagatcaattagatacacaagaaatataaacaattctataagaagaagtaaaacgattgcactttgtagatgctgtgataatatatatggaaaaccccaggccataaaagataaaactaacacaagtaatacaataatttattgtgaatatatcatgaagctagctataaaataaacagtcagaaagcaaatagctctcatatacgcaaacactaaccagttagagaagaaaatcaagtttataaaaacagcaagatttattaaattgtttagaacagagtgaaaaatgttataaaaaaacttttaaaaaatgactgaaaatgcaaagtcaccctatgttaatttaaaaactgaattaaatccaaactaaaacactttgttatgttttttatcatattagacagtttgacactaaaactgacatagaaaaactaacattcaagaatagtcataaaaacactaaaaccaaaaactatgatggagtactagccttctagacattaaagcatacaataaaactttagtaattgaaataatatgttatcatgcatgaatagacaaagcataattgactaaactccagtacctatggatatttaagaataaaccttagtacatatggatatttaagaattggtaaaggtggcatctcatattactgaaacaaaaatggagtttaaaaaaatatatagcaacaaggcaaatggctaccattggaaaactgatgaaatcggatgcacacctcacattatacacaagaataaattttaaatgtttcagagatctaaatgtaaaataacctctgaaacaatgttatgcaacaataatgaaaccatgcaaatactggaagaaaatatgggtacattctttgataatgagtgtaggagataagatttataaatatgactcgaaatccagatgcaatgaattaacagattaataaatttgacaatgtaaaatattttaagaaaattctcctttgcaaaacacaaaatcaagaaaggcaaaaggcaactgaaagactgggagaaatttttggcactgtatatcatatataaagagttcatgtcattactatataaagaactcttatatgctgaggtaaaaacagatctatccaacaggaaaaaaatgggcaaagacataaacatacaattcacaaaaatatatattaaaatggtacttaaatatatgaaaagatgttcatttcaattatatttttaaaaatatatattaaaactacaagaagatattatttctaatatatcacagtggcaaaaattaaaatttataaaaataaattcctgataaaatcatcaaaatgtaggaattctgctggaatagctgtagggagatagggactctcacaaatctacttttgatcctacaattttcacttattggaatttaccctgaagatatacttccaacaatatttttctatattgttggacacaaacaaagttattcattacagcattatttataattgaaaaatattaaaaataaataggtatacacgggagagtgaataaactatggtacacataaaaaagtacaatagagctagataaaagtataaggtatacatttgagaactaatacagagttgtttacaaaatatatatttcccagagggaaatgcaaagggcaaaagaatatctttagctttatcttttctgtaagaaagaaattttatgtcagtgagacaggatttttcttggcccctttgcccggctcacatcaggaggtgccctggctactcagctggctgggccacatctagcttgcgctctggctggcggctcccacagccactgcagctgcctactcagcccctgatgtggggtggggtgtgctccatgcagggcttgctgctggaccaggcatgctgctgtgaggagaacgcagtggtgcccagacaggggtgctggtgaccctgaagccctagaaggagtgttgtaacatgctaattagctcttttagtcccaccgtctgcagcctgagggatggtggcatgttaacagttcagtcagccccttgcctcattccagcctgcagcgccagggctggctcagccccattgctgcttcttgttacatggggtggctgccctccactggtggaaggcagagggtcacagcattacacccttctgagtacccacatgcagtgggttctgagttcttgtcctgtgtccaagaagaaagaggtcatgctgacaattgaagggtaacaagggtggagaactttattgagcaacgaaaccgctctcagcagagaggggatgggaaggtggtctctcacccaaagtcgggttgtctcttccagtgtgcctgagtctggggtttttacaggcacaggatgtggcaggggcaggttgtaggtagcattggaaaaggcaacgtctgattggttaaaaagcattattcagaaagaaccaagagagaaagcgtgggcaaactcgaacagaaattctcactctaggttgtggagttcatccagaaccaacagtcccttctttcaggcttcaggctgttttgaccttgaaggtgcagtttcacctggaatctgcccctggaatctgcccctatctgcctaggcatttgtctgcttcctgccactatcataaacatattgtatgcttttaatatatgcacaaaaatatgtatataactatatatatttactcatttgtgcaaaaagatataaatagaaaaagttaacagaaacaaacagaaacgataaaccagaaatgaatgaggttggttttctgtaagaagtgaatagaaatggattgaaaaagatagactaaaatgagagagaacggagacaagaaagtacatttaaatataaatatgtaggatataatgatctgagatgcattttaaatcagccactctaactacttattaacagctttgaagaaagatttctttaaggaaaggctttaaaactagaagctaaaaagaattttttggattatctgtggattttatttcatccttgataagcatgagctccgtgtcctctagggatacaaatgaacaagtaaaactctaaaagtcagaagtcagtttcttcaaagctggctgtattttagatttttcaacagatttaatttacaatattttctaatatctgtcattgtaagttggttatattgaggtacaattttctaaatttatttctaaaaactacaaacatatataaatgtttgattacgtaaaggagattttcctcaaaacatttttcttttcatacagtctccaaagagatagtaacacgcaaagtttgcgattgaggtagagaccaaaaaacccacaaccaaaccaaaacagcaagatttctgatcagggcctattggaggtaaaagagccaaatttcttgagaggagaataatgttattcaagaagattttctaaataaagatggttaggccaatgataaaaatggtaggtatttttttgaaccagttttactcttcttagaatttaaaaatcaagccgttcaaattaacagttgcagtgttaacagtgaatgcctgttaaaatgaagcagttaatcaccaggaacagcatattaaaactgttaatttgtaggtttgaaacttccctttaattaaagctgtaggaaaagcttcctgttctaagcaaatctgagatctcacggcctctgtcatgcttgtgaaatatcacaaagaaaagctcttttggaggggagggtcaaggtgatgatgaagggaaatctgagtgcttgatttgaaaggattaaactttcttcccccttagcctttaaaaataatctataacagaatagcaatacttttgatttctggaaagtgacaaatgcaatcagactgcataagtattctacagagttagtgggctgcatccagatgacacaaatattagaagagaaagaaagaagaaggcatttctagaaacaaagtctaaaaagctagcatggctgggcttggtggcttacgcctgtaatcccagcactttgggaggctgaggcaggcggataacttgaagtaaggagttcgagaccagcctggtcaacatggtgaaaccccatctctactaaaaatacaaaaaatgtgccaggagtggtggcgcatgcctgtaatcccaactactcaggaggctgaggtggaagaactgcttgaacccgggaggaagaggttgcagtgagccaagatcatgccactgcactccagccagggcgacagatcaagactctgtctcaaaaataaataaatgaataaataaacaaacaaataaaactagcatcacagagtgagattttgggggtagggagttgttgataaccatatatttgaagttagtaggttttgatccctgagaccagcttcctagaccactgcctctccgattctagtactacatgagggagatttgtgaaacattgattccaggaccattgctaatagagattctgatttagtaagctttaactgagccgggaatctccatttcactgtctatcccacaagttgttcacacaggtgcttcagaggctgactttgagatatgctttttaaaaaaaatttacaccctcaagaatgctttttcctcaagaatgctattctggtgagttctctgtatggatgaaaaaaacagcagaaaccagagggcatattagaaactatagtcataaataaataacagttacaactatcatgaaatttttaagtactaagaggtggaaataataaggaaaatagataattcaatttctaatgtaggtatgtttatactaaataaaacatgtgttgtgaaaatcagcatcaaaaaagcagcaaccaggataagttacatcgaatatcctcatactatcgactctaaacatgggcttctaattctgtttacaaataaatcaaaagcaatgactagcatgtattttctacagatactagttatgttgaaagaacattgaatatactaaattttaatagttgcaaagcgctatgcaggatctacaattaaactaatcattttcaaaatactgaaaactgatagataatatgaaaaacttttttcaaggacacaaatgtatcatttgctggtaccaggacttgattaattgcttaccttattaaaaaatacaaagattttgtgtatatgcatgttgagcatttatcactcattctgtgcctggccagatgacgtatttttagatcctcagatctagcacaatttaaggtatatatcagacagtatgtaaatgtttcttgaatgagatcactttccattaaaattttatattttaaagaaaatcatgaaatattatttttaaaataaaacatgatttttattacttcccacatgttgcaacccaactaacatacctcaatatgggcatccaccttggcagtgatggcaatgtaggctactagctaaggatgcaggctctgggtctgcaagacttgattgctaatatttacagactatgtggtctaatgcaattacttcacttctcttagtctcagtatattcaattataaaattagataataaaaataattacctcaaaagttgtttcatagattaaattagcattgtttgcatcacacaaatgcccaataaatataaattattcactgaaacagctgtaggcagtaatgaaatttccatttcatgaataaaaatgtaatgtttcaatcacatatatgctacaatattaattatgttctgattgtcaggtcaaaaagtagaaattcaacctataccactacatctaatgtatgataatgataattaaggagaaaggatgtgttattattggtaatgacaggaaaagattattccaaagtaaattcaacaaagaattcttagaaaaactgcagtgtacatttgttgacacaaacaacactcacatacatattcacatggacatatacacacataccactacatatgtccagtattttttaatatataggaataaccatagcttctaacagcttatatagcatgtaactgacattcaataagctgtacataaagtttataatttcataaaatttagcacatgtaaacaagcatgaaattcaagaatcaaaataataaacatacgtatcgtgttcaaaagttttctcaagcccttttgtaatttattcctctcactgattttttatatctatacaatctatagcgatatctcctcttctgtaactgactttagtaatttatgtttttaatttcccccaaattagtctgactagagatttattcattttaatgatcttttcagagaatcagcttttcatgtcactgatatttttccccattgaatcatattttttatctgtttggtttctcttctttatttcataattttggcttgctttatgtctaaaatgtgttttttttaaactggtatcttaaagtggaagtttagttaagtgaattttagatcatgtttttttctgatttatgctctacatacatttctctctaaacattttattaactatatctcataaaatctgaaatgctttatttttattgtttcatgtgtgtatgtatatatgtacacacatatggaaaatatttctgttttcctttacttttttattgatcatctttaggttacttagaagtatgtagtttaatttcacatatctgtgaattcctagatattgttctcttattgctttagaatttaattctgctatggtaaaaatgcatactttgtatgattttagtgtactatactaattgaaaatatactgagacatgtttatggcccaaattatattctatcttgatggtattttcataggcacatgaaagaaaaatggatgctgctatggctaggaggagacttatacaaatgtaaactatatcatgttacttgagagtattaagttctttatacctttactggttttctgtcttttgttctatcaattactgagagaaaaatattataagagtatttgagtgttttcaattttgttagtttgggcttcatgtattttgaagaatattttgatataaacacagaagtgttatatcttctttatgaattcacctttttatcattatgaaaaggctctttttaatattctacagtctactttgtctgacattcagatttcagatttcttttgatcattctctgtatggcttgcattttccaaacattttactttcaatctgtctatataattaaagtatattccttgtcaaaagtatatagttagaccttgctcatactatcttacaatctctgcttttcaaataaacttttaaacccatttacatttaatgtaattgtagatacgtttggttttaagtgtacaccttgctgttttctatttaagctatatgttctttatctcttttttccccatttttctgtcttcttctgaaaaaattgagcatttttaaaattctatctccactattggttctttaataatactcttgtttattttaaaatttgttttccaggcttacattatgcatctttaaattattataatctagtgtaaaataatgttatggcatgtcacatataatgcaaggataatgtaagtatccttacaaaagcatacttttatttcctcttctttttttttgctattattgtaatgtattttatttctgcatatgttggagatttaattatctttaagagatctaaaatgaaaataaaattattttttatgtaacaacatatttaacatttacagtgatcttctaaagctttgctgttttgatacagattctgtatggtttcattctccttctacttaatgaaccttcagtgttttttatagaacacatctggtaataaaatatttagcttatatttcttaaaattactctttattttgccattttatttttacagatacatttgctaaatatatatttctaggttgaaattcctttttcttttagtgctttaataataattgatttctagcttgcattgtttctgaaaaaaagtctaatgtcattctgttttgctcttctctatataatgtatcttttttctctacctctaatatttagttttcatcactgcttttcgaacatttaattattatacatattgatgggttttttcttatttttcttctgcttgtatttcacatagtttcttgaacttttgatttcaaaaacaacttcagtatattttcagtcatcatttcttcaaatattaatgcagattgtttttctttcaaatatatagtctgggttacctttcggatattataattttcgtctacagatgacccatgatatggtttggctatgtttccatccaaatctcatcttcagtagtagttcctataattcccatatcttgtgggagggacccagtgggaggcaattgaatcatgggggcgtttacccccatactgttctgatagtgagtgagttctcacaagatctgaaggttttataatggtattttccgtctttgctcagcacttctccttgatgtcaccatgtgaagaaggatatgtttgcttccccttccaccatgactgtaagttttctgaggcttccccagccatgctgaattgtgagtcaattaagcctctttccttaataaattacccagtcttgcgtgtgtctttattagcatcatgagaatggattaatatagtaaattggtgctgggaatggggcagtgctgtaaagatgcccaaaaatttggatgcaactttgaaagtggataacaagcagaggtgggaacagtttggagggctcagaagaagataagaaaatgtggaaaagtttggaacttcttagagacttgttgagtggctttgatcaaaatgctgagagtgatatggaaaataaggtctaggctgaggtggtctcagatacagatgaggaacttgggaactggaataaaggtgactcttgctatgcaaagagactggtggcattttgcccctgccctagaggcctgtgtaattttgaacttgagagagatgacttagggtatctggcagatgaaatttctaagcagcaaagcattcaagaggaagcagagcattaaagtttgaaaaatttgcaacctgacaatgcaataaaaaagaaaagcccattttctggagagaaattcaagccagctacagaaatttgcataagcaatgaggagccaaatgttaatcaccatgacaatggggaaaatgtctctagggtatgtcacagacctttacagcagcccctcccattacaggtctagaggcctaggagagaaaaatggtttcctggactgggcccacagatcccctgctgagtgaagcctcaggacatggtgccctgagccccagctgcttcagctgtagccatggctaaaaggagccaacatacagttcagggcattgcttcagagagtgcaagccccaagccaccagcattgagccttgggtacacagaagtcaaaaactgagaattgggaacctctacctagatttcacaggatgtatggaaatgcatggatgtccaagcagaaatttgcttcaggggtggagccctcatggagaccatctgctagggcagtgtggaagggaaatgcaggattggagccccccacaagagtccccaatgagacactgcctagtggagctatgaggaaagagtcactgtcctccagaccccagaacggtagatccaccgacagcttgcactgtgcacctgaaaaagtcagtgatactccacaccagcctgtgaaagcagccagcaatgggtctgtaccctccaaagccagaggggtggagctgcccaagctgtgggagcccaattcttgcatcagtggatgtaagacatggattcaaaggagatcattttgaaactttaaagtttaatgactgccctattggattttggacttgcgtagggcctgtagcacctttgttttggccaatttctcccattcagaacaggcgtatttactcaataactgtacccccattgtatctaggaagtaactaattcccttttgattttacaggcttataggcagaagggacttgccttgtctcatatgagactttagacttggatttttgggttaatgctggaatgagctaaaactttggagaactgttggagaggcataattgtattttgaaatatgaggaaatgagatttggtaggggccagtggcagaatgatatggtttgtctgtgtccccacccaaatctcatcttgaattgtagatcccataatccctacatctcacaggaggcatctgctggaaggtaatttaatcatgggggctgttacttccctactgttctcgtgataggtagttctcacaagagctaatggttttataaggggatttcccctctttgcttggcacttctccttgatgttgccatgtgaagaaagtattcgcctcccctctcaccatgattgtaagtttcctgaggcctccccagtcacgctgaaccatgagttaattaaacctctgttctctataaattattaagtctcagttatgtctttattagcagcatgatggactaatgaactaatataacccatttgtttcttttttatatcgcatttctgtcctcatgtttatgttcaggtttcccttcaactaattgagttcgtaaagtatatttattacagttactataatgtttttggttgataatcctttcatatgtttctatttattcattgactttttcctagctattgataacatatacttgcctcatcttatgtaatttctaattgaacatcagatattgtgaattttgtcttgttgagtttactcaacaagtattttgttgtatttctttaaagtttgttggacttttcctggtatgctgttatttaacttgctgatgagcattatcccttttagtttctttttaatattttggagagataaaatttagcttttatcttagagatgatttatattcatttcttcatgtggctttctgcaggttttacttaattctctgtataattggtgaagtttctccactctggcttggaagaacataaatgattgtctgctctgtgtttgcactgggaattgttttctatacaccaaccccattaattgttcttttctcataagttattcttaaccaacagagtttggattttatactctgcatgcacagacttgtatccagccaaatattcaatggtaccccaccacagacttctggacctcattatctgcctaacccatacttcgtgaatgaataaaagaagatgataattttaatggcttattctagtcatttgttggcttattagcacatcattaaagcttatgaagaaaaatattattttaaattcatttaacacaggaaaaaagaatatgaagcttagctatagaagatcaagatattttccactttaccatagggtgcagaataaacttaataaagtaacagcaatgtgagaaaaaattattgttattctaaaactgttaattttgatccatgatgttaaatatttatagacagtactaatcagcatcgtacctaatcttggtactatgcaccaaattttggtgcaaacacttagtacctgtattatatttggcaagttatataaaataaattctaatttagttattgataattttagtttcacaagatgatgagattaaaagtaaaccatatgtacctggtacaaaatagaaacttaatacattaataaatcattaaaatatgttttaagtaagctagatggctgtcatcaaatccaagcagaataaacattaccatagacagcttttctggagaaattaaggtctccttcattcctaagaggtttgaatacgggtggtcagtaagatggatagctccccgtgaggaaatggttttaagacactccattccatgtaagcctttatctttagtgctccagggtttattcagttactactatctgttctttgagactagcctctttttttgtagaaggctgtctctgtggatttgtgcaattatatttctccctagagtttttggtcttcatcaattttgttacatttgttttctttttttttttttctcaaaggtgtagtaccttcttatactgagtagccttttccatgatgctcccatcttacttagatgagatagtactcatgtcatggtataaccctaatgtcctcttaccacaaaatacagtaagtagattggataatacaaaaccataatctgtgtgcaatagcaccctcattttaggcagtaatgtctcgtctttaggacattcatttcttcttaatcatttatcacatgtgctctactcctgaagcctatactttataagactctctttttttgttattccccaaatgagtacctctattataacttcaagatatttcatgttgtgtcacaattcaggtttcccttcaaataattgagttcgtaaagtatacttattatagttactacaatgtttttggttgataatcctttcatatgtttgtatttattcatttactttttcctactatctctcacttttactttctcttgctatctctttatcacctccatataacgtgattatcaagtaccaaagagtatttttctcctcttatatgtcactccttcagttcacctctcttaacttttaggtatctcgagtatctttttctccagtttatccgcttaatgattatactacaacacaaatcagagtatgctgctctcctcagacatgcctttcaaaaccttaccttttattataatattaagaaaagcttttcaggactagatctgtgataatgtttaccacactatcaaattctatgaaacatagaatttgttcttgaagctatataaccatgtttatattttttagtcaattacttagacaatgtttcttgtaatatgcctcattcccacaaaataaaatagcagtcattgaagtgggccatgtgtattttttagtattgagcatgttgaagagggtagagagacctaaaagaatgtcacggtgtgagaaatatttttattcactacaatttgccacatgatgagggtgaagaataatttataatattagaactgagagtgaaatgttatattaataactcatcccagaaattttctcaaagagaaaatctgtccttttttggagatatttcaatgtacttatttggtaataagttgagattttctagttatatactgagagaactgagataagacaaagaaggaactagaaaaaagatagattcctgataataaaaaatataatgaatatgattttgactgggtagttgtggtttagcaaacttgggataatagagcaggaagtcagtgtgcctaataggctaggactttctatgtacaaacaatctgtgtgaaccttctgaggataaaaatggcaaaggaatttttaagaatatgaatggatattaatagtaagggtatgctttatatatagtaatatgatgccatttctattatatcaaaccatcagtagatagttatctcacaccaagtcttatgctactacccctttatggaaggaaaaagaatgggacctattaggatgaagaaatgtgggaaaacaggataggcatatgttccaaaaatcatagagacttagaatataattatgttatgtttggaggacagatatacactggtaaaagagatactccctggccttctaaaaaattaataaatctacagatattggaagaaacaatagtttcttcttaaagattttgagtgaaattaatcaaaatttgtaaagacgggctatctgggttaaaatataacaagcatcaaagaatactgctatcatttgaatgtttttgtcttctttaaaatcattgtgttggaaacttagtctccaatgcaacaatgttgggagatggggactaatgggtttagttcataagggctctgtcctcaagaatgggttaatgccactgtgtttgcagaaacgggttttgtctctttcactcttctgccatgtgatgacataatgttcttcccctctggcaaaagcaacatttaaaataccatcttggaagcaaagaccagattcttatcaaacacccaaagtgctggcttcttgatattgtaacttccagctccagaactaagagaactaaattttatcctttatacattacccagtctcaagtattccattatagcagcacaaaataaactaagacaaatattttagcatgatatgttttcttatagttttaatatataatttattctcacacactgtatttattaaagtcttccatttatttatttaaactgcatagttactagtaattgtgcaagtttgttattacagcaagctgaggatactacaataatatgtaccttaaagaatacagttacattttttgggggggtcaaataagcatataatcactgaatttacagaattatttgtctttgatattaagaagttaataatgtgatggttttggtaataatagtgacctctaaactctgtacccataacaactgttcttctttttatggacagagttttattaacaagaactgtctttatgcttcagtcacctttcaataccatacccctgcatctcagcttttccctaagcctaaaaattttatttatagttttaaactaaacacttctaaaattgaaattatgtctccctttggttctatcaagcttacatctcttccctgttttttaattctgttaataatatcaccatctacttacttactaaaatgtaagacatggcttcatctgcactatttctctcactatctctttgtcacctccatataacatgattatcaaggactaaagtgtatttttctcctcttacatgtcacacttcattttacctctcttaactttttggtacctcgagtatctttttctccagtttatcctcttaatgattatactacaacacaaatcagagtatgctactctcctcaaatatgcctttcaaaaccttgccttttattataatattaaggaaagcttttcagtactagatctgtgataatgcttaccacactatcattttaaccttattatataatactttctaaaatatcctttatactctaaacatatcaaatttttctgtcattctaagtacaacatattcattcttccacattatgtactgacattcttttctccctctactgcatgaactactacttatccttaaacactgagttaaaatgtcagcactcttctaaggcaaggtataaatttcaatggcagatcaaaaatacctgctactacttaacttattcacttagaatctattagaatctacacgtctctcaaatgacaaattgactttctcagatttagttgtttcctaccaatccatagcatattgaagagtgagatgaccaggaattaaaattccatgatatgtcacaggcctgtgccttgctgcaataaagtatatgaacatttatatcagatagttggtgccctttaatatctatgaacaaaagtcattgatacagatatttgagaggaaagttaatgactttgctctgcatatgctcatttaagaaaagggattataaacagatttgcaaggtcagcagagcactgtaaattaaggatatgcctggagaagattgaggtcatgtagcagattgcattggcttaccataaagacttaccttcagtaagcttagagaaatagcagaaaatatcctacatgaaaaagagtcaggcaataaaaagaaagcttgattcactttccaagaactgggaatctaaagtgaagtaatgctccatcaagaaattcaaaatgccagctggataacacatagctgcagagagaccaaatactcaattaggacactcatgaaaagggagacctaagccaactaaaggaagaacgtgagcttaaaccagaaactaaggacatatttcttccaagaagtatttcttgaagtttttttctagtcatctgagatatatagagaatatatttctctatgttttatggggattacaattttgaacagatgggaaggagtaaggggatatagccctgaaaaagattagaagaacaagaaaccttatacctaactaaggcaaaccacagcattttgaagatgagaaaactgaggctcagagagggtaagatcatgctctcaactcacattccagtgcgtgactccagtaaggattggctttttagtacctaattcaaggtctgatgtcaggatgtcatcataaattaaaagctttagaaaataatgaaccacatttctggaacaatcccctttatgaccatttgggtagaactcttttagtatgaatattattgtcatttttggtatcttgagatttaactatcttgatgatatacaaaattggaaagatcaatcactaaattctgtgggggctaaaatcatttttgctttttcttggtcttaactagtggatctaactatctgagaacactccttagatagaggtgaaatttatggttagtgttcatcctatgagtagagagataaagaactggtaaatcagtgtttgcagaaatttcatttttttctttcttatagcttatgtaaacaaacaaggaagatctgtatgcttccagaaacaaactgtatctgcaagtcaaaaatttatgtattgtcattgtttatttattctttgccctgttaagcattttactaagttttttttcattttataatgtatcaatattttctcagtcatgtgatggataataaaaaagtttatattcataacgggacataggcttaaaagggaagctgtattactattaccttatgtagtatataagtacacaaaattaaaaatatgtaattaaaatacaaatatctcttaacctgaaagagttaatgcatcatttcctctctagttagaaacattaacaatttaggtctctgtccttcatgttaacagattcaacactttgatacatgactcaaatgtacagaaaacatgtttataatataaaactgatagaaatcatgaaataataacaattacagtggttacagaattaattaagatgatcttggcaggttgaaacaaacggccatgtgtttaataaaatgaagaaaagtgaatatcaaatactgcatttagattgaaaaaaatcaaacaagaaaagtttgaagaactatgttatttctaaatgcatttcaaagttttgaagtatattttattttttaagctatcttttaagtgtaggtttttgagttgccttatggttaaaaatgtgttttacgggtaatcatttctttgaaattttagttagttttatataacaatgtgttgaatttaaggtattttactttgcttaatatatcagtgtctgatgacactgcagagtttgcaatttttgctttactacttttttgacaatgttgttatatacataaaatgtcataaccttctaagtaaattttattttaattattatgcatatacctatttacctatgttaatgccattcccttaattttaattttgtctattactatattggtataataacattcttctgaacagtctttgttcattagatatttttcccatttctttatctggaacatttcaaagcaattttatttgtggtatgacatttaaaagcagacgatagctaggtacatttttgtttctatcaacaaagtctttgtattttagttagtaggtatatgtaagtcatttacatttattgtgataatatattttaccttttccattatcttactctgcctttcatagttaccttttttttcatttttttctgtaactgttaaactgatactattttgtacaacttaaccttttctttattaatttactggtttggaagttattaagtataatatagttttccttcactatccatggaggattggttccagaattgtttcaagaatagtgacaggagcgggtggagccaagatggccaaataagaacatctccagtctacagctcccagcataagcgacacagaagacaggtaatttctgcatttccaactgaggtaccgggttcatctcactggggagtgccggacagtgggtgcaatgcactgtgcatgagccgaagcagggtgaggcattgcctgacccaggaagcgcaaggggtcagggaattccctttcctagtcaaagaaaggggggacagatggcacatggaaaatcgggtcactcccaccctaatactatgctcttccaaaggggttaacaaatggcacaccagattatatcccgcacctggctcggagggttctacccccacaaagcctcgctcattgctagcacagcagtctgagatcaaactgcaaggtggcagcaaggctgggggaggggcacccatcattgctcaggcttcagtaggtaaacaaagcggctgggaggctcgaacttggtggagcccaccacagctcaaggaggcctgcctgcctctataggctccacctctgggggaagggcatagacaaacaaaagacagcaataacctctgcaatcttaaatgcccctgtctgacagctttgaagagagtagtggttctcccagcatgcagcttgagatctgagaaagggcagactggctccacaagcgggtccctgaccccggagtagcctaactgggaacaccccccagtaggggtggactgacacctcacatggcagggtattcctctgagacaaaacttccagaggagcgatcaggcagcagcatttgcggttcaccaatatccgctgttctgcagccaccactgctgatacccaggctaacagggtctggagtggacctccagtaaactccaacagacctgcagctgagggtcctgactgttagaaggaaaactaacaaacagaaaggacatccacaccaaaatcccatctgtatgtcaccatcatcaaagaccaaaggtagataaaaccacaaagatggcgaaaaaacagagcagaaaaactggaaactctaaaaatcacagcacctctcttcctccaaaggaatgcagctcctcaccagcaacagaacaaagctggacggagaatgactttgacgagttgagagaggaagtcttcagaagatcaaactactccgagctaaaggaggaagtttgaaccaatggcaaagaagttaaaaactttgaaaaaaaattagatgaatggataaaactagaataaccaaagcagagaagtccttaaaggacctgatggagctgaaaaccacggcgtaactacataacaaatgcacaagcctcagtaaccgatgcgatcaactggaagaaagggtatcagagatggaagacaaaatgaatgaaatgaagcatgaagagaagttcagagaaaaaagaataaaaagaaatgaacaaagcctccaggaaatatgggactatgtgaaaagaccaaatctacatctgattggtgtaccggaaagtgacagggagaatggaaccaagttggaaaacactctgcaggatattatccaggagaacttccccaacctagcaaggcaggccaatattcaaattcaggaaatacagagaatgccacaaaatactccttgagaagagcaactccaacatacataatgggcagattcaccaaagttgaaatgaaggaaaaaatgttaagggcagtcagagagaaaggtcgggttacccacaaagggaagcccatcagactaacagtggatctctcagcagaaacgctacaagccagaagagagtgggggccaatattcaacattcttaaagaaaggaattttcaatccagaatttcatattcagccaaactaagcttcataagtgaaggagaaatacaatactttacagacaagcaaatgctgagagatttttgtcaccaccgggcctgccctaaaaaagctcctgaaagaagcactaaacatggaaagaacaactggtaccagccactgcaaaaacatgccaaattgtaaagaccatcaaggctagggagaaactgcatcaactaacgagcaaaataaccagctaacatcataatcacaggatcaaattcacacataacaatattaaccttaaatgtaaatgggctaaatgctccaattaaaaggcacagactggcaaatcggataaagagtcaagacccgtcagtgggctgtattcaggaaacccatctcacatgcagagacacacataggctcaaaataaagggatggaggaagatctaccaagcaaatggaaaacaaaaaaaggaaggggttgcaatcctagtctctgataaaacagtctttaaaccagcaaagatcaaaagagacaaggccattacataatggtaaatggatcaattcaacaagaagaactaactatcctaaatatatatgcacccaatacaggagcacccagattcataaagcaagtccttagtgacttacaaagagacttagactcccacacaataataatgggagactttaacaccccactgtcaacattagacagatcaatgagacagaaagttaacaaggatatccaggaattgaactcagctctttaccaagcggacctaatagacatctacagaactctccaccccaaatcaacagaatatacattcttttcagcaccacaccacacctattccaaaactgaccacatagttggaagtaaaacactcctcagcaaatgtaaaagaacagaaattataacaaactttgtctcagaccacagtgcaatcaaactagaactcagtattaagaaactcactcaaaaccactcaactacatggaaactgaacaacctgctcctgagtgactactgggtacataatgaaatgaaggcagaaataaagatgttatttgaaaccaacgagaacaaagacacaacataccagaatctctgggacacattcaaagcagtgtgtagagagaaatttatagcactaaatgcccacaaaagaaagcaggaaagatctaaaattgacaccctaacatcacaattaaaagaacaagagaagcaagagcaaacacattcaaaagctagcagaaggcaagaaataactaagatcagagcagaactgaaggaaatacagacacaaaaaacccttcaaaaaatcaatgaatccaggaggtggttttttgaaaagatcaacaaaattgatagactgctagcaagactaataaagaagaaaagagagaagaatcaaagagatgcaataaaaaatgacaaaggggatatcaccaccgatcccacagaaatacaaactaccatcagataatactataaacaactctacgcaaataaactagaaaatctagaagaaatggataaattcctcgacacatacactctcccaagactaaaccaggaagaagttgaatctctaaatagaccaataacaggctctgaaattgaggcaataattaatagcttaccaactaaaaaaagtccaggaccagaaggattcacagccaaattccaccagaggtacaaggaagagctggtaccattccttctgaaaatattccaatcaatagaaaaagagggaatactccctaactcattttatgaggccagaatcatcctgataccaaagcctggcagagacacaaccaaaaaagagaattttagaccaatatcctcgatgaacatggatgcaaaaatcctcaataaaacactggtaaaccgaatccagcaacacatcaaaaagcttatccaccatgatcgagtgggcttcgttcctgggatgcaacgctggttcaacatacgaaaatcaataaatgtaatccagcatataaacagaaccaaagacaaaaaccacatgattatctcaatagatgcagaaaaggcctttgacaaaattcaacaacacttcatgcaaaaaaccctcaataaattaggtattgatgggacgtatctcaaaataataagagctatctatgacaaacccacagccaatatcatgctgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgattgtatatctagaaaaccccattgtctcagcccaaaatctccttaagctgataagcagcttcagcaaactctctggatacaaaatcaatgtgcaaaaatcacaagcattcttatacaccaataacagacaaacagagagccaaatcatgagtgaactcccattcacaattgcttcaaagagaataaaatatcaaggaatccaacttacaagggatgtgaaggacctcttcaaggagaactgcaaagcactgctcaatgaaattaaagaggatacaaagaaatggaagaacattccatgctcatgggtaggaagaatccatattgtgaaaatggccatactgcccaaggtaatttatagattcaatgccatccccatcaagctaccaatgactttcttcacagaattggaaaaaactactttaaagttcatatggaaccaaaaaagagccctcatcgccaagtcaatcctaagccaaaagaacaaagctgggagcatcatgctacctgacttcaaactacactacaaggctacagtaacccaaacagcatggtactggtaccaaaacagagatgtagaccaatgcaaaagaacagagccctcagaaataatgccgcatatctacaactatctgatctttgacaaacctaacaaaaacaagaaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcattaccattcaggacatgggcatgggcacggacttcatgtctaaaacaccaaaagcaatggcaatgaaagccataattgacaaatgggatctaattaaactaaggagcttctgcacagcaaaagaaaccaccatcagagtgaacaggcaacctacagaatgggagaaaatttttgcaacctactcatctgacaaagggctaatatccagaatctacaatgaactcaaacaaattataagaaaaaaacaaacaacccatcaaaaagtgggcaaaggatatgaacagacatttctcaaaagaagacatttatgcagccaacagacacatgaaaaaatgctcctcatcactggccatcagagaaatgcaaatcaaaaccacaatgagataccatctctcaccagttagaatggcgatcattaaaaagtcaggaaacagcaggtgctggagaggatgtggagaaataggaacacttttacactgttggtgggactgtaaactagttcaaccattgtggaagtcagtgtggcgatccctcagggatctagaactagaaataccatttgacccagccatcccattactgggtatatacccaaaggactatatatcatgcttctataaagacacgagcacacgtatatttattgtggcactattcacaatagcaaagacttggaatgaacacaaatgtacaataacgataggctggattaagaaaatgtggcacatgtagaccatggaatactatgcagccataaaaaatgatgagttcatgtcctttgtagggacatggatgaaactggaaaccatcattctcagcaaactatcgcaaggacaaaaaaaccaaacactgcatgttctcactcattgatgggaattgaacaatgagagtacatggacacaggaaggggaacatcacactccagggactgttgtggggtggggggaggggggagggatagcattaggagatatacctaatgctaaatgacgagttaatgggtgcagcacaccaacatggcacacgtatacatatgtaacaaacctgcacgttgtgcacatgtatcctaaaacttatagtataataataataaaaataaaataaaataaagataaattaataaaaaactagaatagtgacaagaaaaaaagagtatacatgctcagcagatgtaaccatccattttttaatcaaatatatatatattttgttatatttaatcatgtgtgtatatatatatatatatatatatatataaaatagtttgtttgattgtttgtttgcttttgagatgaagtctcactctgttgcccagactggagtacagtggcaagatctcagctcactgcaacctctgccttccaggttcaagccattctcctgcctctacctcccaaatagctgggattacaagcgcatgccatcacgactggctaatttttttagttttagtagaaacagagtttcactatgttagccaggctggtctcgaactactgacctcaggtgatccgcctgcctcccaaagtgctgggattacaagcatgagccaccatgcgtggcctattatttttgatccatgggtagttgaatctacacatgtggaacccacagatattgagggatgactgtatatggaatttataatatatttatatgtatatgttcaaataaaattttaatataaatgaagtatgtatcgaacaaaatcaattgttattcagtatttctgtctttctcccaatatggcaggaaatctctccatgctttacccattgtaactactagcccaacctgcatatctttttaatattttaaagtgtctatttcacttttttaaacttagaaaatagttattattaaatccttaatcaaatttactgatatcattcatcaagctctatgcttgttcttccttgtaatctgtatatgctctcttggttcattgggttcactgaccttctaatcaagtacagcctcccaaagttatttgagttacttagggtgctaaactctttctattataacttgaaaataataatttagctctctctctcaatcattaagctgggaatataaacaggtaaacagcttcaccttttaatgtttgtttaactttaggaaattctcttctcaaggcctcagctttctcatttgtaaaatgggaataagagtaactatctcacaagatatacaaattattgagaacccagaataagtccagtggaacggtcaatttttatttttagcaactacattgttgtttctggaatatattgttactaataatacccattttttatatgagtgtgcttttggttttatcattaccagtagattttaagattatctctgttttcttcaattttttgtaatttgactgcagtgtttcgtggtatgggtttgctttttcttaaatgaatatggctcagtacttaaatttgtaaactgggaactcatatctccctttatgtctagaaaactctcagcaattatttcttcaaatatattctaccattatttctgtcattcattatttccaaatagtcttaaagtgaatactaggattacttagtctatcttctatttctcttaaatattcttttgtgttttttaaaaatctctccacatttaaactatactcacagagtcaccctcatcaaaagtcaagacacacaagtgtaatacaaataatctcaatgatcagagttatagatatgtcggtagtttcaagggaaatgatgtagtgataaggtagtacttttatcattcctctagaaggtcaccttcttcatctacatttatagtgttaccactttcctaaagaacgtgaaaaatgagaattgcttattttatcatagagatcagtgacagtaacatatattgaaagcttgtgatgtgccaggcagtgttctaagtgcttaaaattatgtttttaatatatgcaaagtgaatgcatttaatcttcacaacaatattaggagcagatcttctcatcatcttcttttaaagatgaaaaaaatgaggctcacaatggttaattacctttcaaatgtcacacagtgagtgaataacagagttataatttcttctttttttttttttttttttttttttttgagacggattcttgctctgttgcccaggctggagtgcaatggcatgatctctgctcactgcaacctctgcctcatgggttcaagcaattctcctgcctcagcctcctgagtagctgttattacaggcatgtgccaccatacccggctaattttgtatttttagtctagatgggtttctccatgttggtcaggctggtctcaaactcctgacctcaggtgatccacccgctttggcatcccaaagtgctgggattacaggcatgagccaccgcacccagtccagagttgtaatttcttatgcagcagtagcaaactaatacagcaatatggatatattttatttaagccatgatgccattttcctttacgagagctgtaattgcctcctatggtttccatgaccatataggctgttgttgttgcttctgctatttttagttgttattgttacattattttcataataataatgttaataaccataagacgttaaacagcactgcaacagagcttaaaaatgctatttgttccttacagtattatgttagtgcaacattcttaagaaagcaggtgaaaagaaagcaaaccagaaatgaacacacttttatggaataaaaacttataaatttgggttttagttaaagctacctgagagggggaaaaatgtactttaaatatgaggtcaaggacagggctggattacacaaaatgtgcccacgattcgtgtacaaatgagaatgcccacagagaactaaaacccacatgacacacagaaaggaacatctgccagcatcagcaaattgatgacatgtataaggcatttcttagaccgatgtgggagtaggaaaacatcacttctttagttaatgatgcttcggcaatgaacatattcaaatgccttggttctgaagacagtgccacttaatgagcatatcatagaccacaagatattgccataagtcagaaatgtataagcaacacacaatttcaagctcttaacagctttaaagcatcttcaccaattacatctggtcacttcctttctagtactcctagaaacatacgaagtagtgttgggtttaggtgtgtgaatgcacgcctatattatcaccattttccctaatgcattatacgtgtataaacttgtgctacacccatttctattaaccttgtatctcactcttaacccaaagagtagcagcttaaaaaacaaaccccctcatataatgtatggataagtccacacaaataattgtaatgtttaattaaactaaactgtcatcaacagaggtcatctttcaacaatcatatatcaggggctttaactgttggaaattaactgtaagattggcttgacttttaaagacagtacgcgagtttctcattagccttattatcatttttgaatcataaatatgtaaatgatgagtttcacacgggagatttaattctgcactcttatttctgattagctggaaatacactctggctctgtcagataattggtaacattgcacaccaataaggcatttccctacgcttcatcagaagcagttgaaattaaagaaggcagagctgttacgttttcgacagttttgtaacaccaacttgttaaagttttaactcagccattaatatagtccatgaattattaatacagtttttatgtcaaggttattttttaaagttgagatccaagtataaagtaaaatgctctaggaaagagaactcttacattattttcacttaaaaaatctatactaaacaatagtaatttgagaacaagtaaaaaacaacaacaacattttgaccacttactgtgaaccacatactcatagtatgtgccatcatactggcacatattggcactcatcatagtgccaaaatgtttgtaaacttttagaagtttggcagtagttgaatttttactgctttaatatatgatgttttgtttttaagatatgcaccttcatttctttgttagtagaaagtatgcataaggaatatcatatcaatttttcttaagttgccttctcctagaaattaggggagttcagtttacctcaacttgaagaagtttaagcagttttaattcataaacatttctcttttttcttctgtcaagatgatgctaagaccttcaacaagacaataaactcctatggataaggaataactctttttatctgtatttttgtcttccatgctagtacacaacaagggtatgcattaagtgtttgtttatgacataaagaaataagttgccacttaaagacatgtaatatttctaaatatgacagacatatctctagtggaaatttttgttttcgcacctctttaagttggctttaaaaaatatttatacttccttaataagaaatttcaatgtctaataactagccatatgtaaatctactagaaacattgtcaaagggactgcaatatttggttggctactattttattttttctatttttaaattagattatcaatatgtttatgaatatttgtgctatatatgatcataaaagctttcaaaacaattgagtatatacttcaaagtttttctactggataaatcctttattatcaccttcactttttttttcaatttttatcatcatcttcgctttataataacaatcaaggtgtagattgattaagtgcaatttttaataagaaaactaaagagggctccctagtgtccgccttgcaataggcagcatttgtgttactgccaacattgcattcattgaaactcattccccataactcctttctcgattttcatcactttctttaagagttgatcattacacagcaccctttttacagtaggattggtgtcctatacgaagtccaaaacaaagagtattccagtgccaactaaagtactaatattttaaagtcaatacatatttgcaaggggtggcttctttttttccaacaaactcacaatatttattcaaaaaaatgtttatgtttagagttgaatgaagaacatttgtagtatagggaaaagatcacacattcatttttgcaggcctttattctagccactatctaattcattcacagctaatttctcagcatcagtaaattttatctaaaaaagaaaagtaagctattacatgaaagacaagatttggtatgaaatttaattgcaattgtcagcatacacaattgaatagagtacattctctttaatcaatcttgtcctcatgtgcttctgcacatttgattccatagtaagttgtgaaacaaaacaaaaataacagaaaatgtgctgaatattaccaaattgagagcaggctaaatgtgtagaaagctatatccaagaaatttaaatcaatcgtatgaggactataatatagaaggcaagaaatcaaaccaagcggtaaaatttccactgagataggcatgtgactgttagaagaaatagatctatggctattaaaaacatgatactagatattcttgttaattagaaatgaatgctcattgctgatctgagaactgagctcaggtgcacttatcttcacacatgaagccatcgtataagatagagtaaaatgagaaatgagccatcaattcccaacttaattatcagccatcatgagtggtgttatgctaccttactgtagtatattaactacacacaattaatgatatggactgtgggcccaagtagacccaagttcaaattctggctttgccattacctaggcacagtatctttgaacttcagtgtcttattaataaaataaggagataaaatctaccttacttgttgttaataggattataagagctaatataaagcttattgaataataagcaggcccattgcatatcactagactttaaaaaaaattcttttctagattttcaaagaaatagttataaaacttgaaggcaaaatctgtctctcatacacacatacatatacatatatatatatatgcacatggaaattagcctaaaatcttacccttcaaaaaaagcaatattgtccattgacagttgtgtgtacagtcttacagatttaatttgtcttactgactagtgtaggcaacgtatttttagaggacattgctctgaaatgtagaatactttaaaaaactatcaatgttcaggtttgaaggggtctaaaaatagcactacccttcccaacataaggaacaacttaaatgagtagtaaaccaaaagcaaatcacacagaacccaatatagcagctatattagtgttaaaccaagttgccttcttggtctatcagggacagtcctgatctagggtggatagatcaattaacatttgtttattctgtttggtacattcttttgttctcaaaagtctctccatatgggcaataaatacataattaccatagccaaaagttatgtggaagaatgtcacttagttttaaagcaacatttaactgccaaagaagaaatcccaccattaaacagacatgtctatctggtgactggcagtactgaatcaccacaggtcttcccgtacagtgacatcatcctacaagcttacagcaaggagggggagcaaggagagaacagcagtttcttgctgtcctcctggctcttaagagaaatggcccagaaagttacgtgatacatgcctcacatattttcctaatctaccagtttggtagctcacttaccatccataggtagcactgaaagccaggccaggacaagaacacaagaatgtttcactgctggatgataatcaatgtagaagcatgaggtcgaggaaaggagtgacccaccttttctaaataaagaatctggctttctatcttggggaggtcactcaataaaaggctaagggagcctaaacaatggctcccattacattttactatgtgaactaagtttttttatattattatgttaaacaaagggaaaatatagaagagtaaaaataaaaaataaaaatcaccaataatcaaaaatcacaaataatccaatgactatgacatacacatatttttgtatatatccttccagtctttttaaaaaataagatgtagttagacataaagaaaagataaacagtaggtatgtggccttcctttatatgaagacacttgagggtttgttctctggttgaatcctccttataatggtaacttaaagaattcaatgaagtgttacaagatcccagaaaaagaagaatctggcaaagttaccatgcacaagatcaaacacctaaaaattgttgcccagattgtttattgagtaatgatatttatgaaatgcagttatatttgtaaatggaagttagtcatgtacccctcaagaggttaagtaactattgggtaagctatggtttgcatgtggtttgtcccaccaaaatttacgttaaagtttaattgccagtatggtagtgttaagaggaggggtctaaagggaggcatttggaaactgaggcatttgatcagattaattaaattcaacaaaattcaggtacctacttgtattagtccattttcacactgctataaagaattacctgagactgggtaatttgtaaagaaaagagattgaattgactcacagttccacatggctggggagacctcaggaaacttacaatcatggcggaaggtgaaggagaagcaagcaccttcttcacatggtagcaggaaagagagtgcatgagaagagaagtgccacacatttttaaaccatgagatctcatgagaactcactatcacaagaacagcaagggggaaatcagcccctatgatccaatcacttcccaccaggcccctcctccaattcaacaagagattttggtggggactcaaagccaaaccacatcactactattagacaagcagtatgcaagtacttaggatgcaaaggcaagaatatattgcctcttatttatagacaaaatagacaccgatcttttttcttgtgtcttccatagtaccctccttgaagacagtaacagaaattgtaaaatgatgttcaatattgaatcagtgaattaccggggaaaaaaaaactggtctcaaatgattttcaagcagatggctaagaaaaggtccttttctaaaaggattattaaaaaaaaaataaatacagccaagccacacaggcatggcgaagcctatggagttttaaaaggttttcttcaatgactatttttatctcctgaagcataattattaggcatcacaaatacaactaagtgaagatttactttcatcttacattattttcatttaaaaatcacaaagcatcaggggacctttctttctatcttgacggttagatgcttctgttccctgctgctattagtcccaaggataaaaatgtgaagttgctataaatgactttgtcaattttatttagaaattcaaagtttcaaactgacaccaagtcaggcaactctaaatcttactgaacttcacccgcatatgtataccttcatggtaattttcttgcacgaagaagagaaagtagcagcagagaattatttttttaagcacagaattatttcccttgctactggtatcacctatgtaatgacaacaatttcaaaatagatatttgagctttgccatttgttttcattaaatcagtcctcagaggagatagtttttttcagtttgttagataaaataatttttctctattattgtacctatcaggctatattacttaatatctgcacaacttgccacaatccagtacactaaatcatctggggtaattataattaaaatattgagtgaatatatagaatatggcagaaaacaaatgaagtaatatttttacctgagttaaataaattttattgtccaatatggtaagcaagaataaatggggcaaaggttggaaaagcaacaatttatagaatagatatcaggaaaggagagcatgaaatagcaaaaagaaacaaaagggctttagaagtcaaattgaaatcataagagaaataaaaataaaaggaatttgtagagtttctgatacagtggcacctcctgggttatatcaaagttattagagattcaaatcaagtagtagaaaacaagcttaatgacagaaaagaaacttcaaattaccttttgaaaatttccatgtgttcatgtccatttacaatattcactatttaagtctgctgagatgttatttttgtttttagagaaaagcaaaacaagtggtttcataatatcttgcagtaatatgtcattgcttcttccagctgtggttgcacaagctgtgagcttattctagccctactctcactttaatcagaatggatttaatagaaccttcccaaggttttggaactacacatctagattctcttgctttgaacctcctcctctcaggtctataactggacttctgaaatgttcctgagatatcaacttcactttgtgccccagtttggataactgggtctctgtcttctctcctctgcttttagttcttatttttatcatctaagcaattctttaatgctgtgaggactgcacctctgctgttttcatgaaagtcacctaaccaggggagggacgcggcctctggatcacagccaaatactcaagcactggtacttgctgacagcctaaactgtgcctatgcttatattaccattgccatgtccactggtatgttttatctactcattgaattatttttgctggaatgaattttttattataccattagcttacatgaaagaacattataaaaattagccagctcttgaaattcatttatgtacggctactactgagactatttctcatcaccttgtataaggagttctttatgaggatccataggaagacttcctctttgaacctacacacaggaatcgttatatctgaaactcattattttgtatttattgtcatgcttgtttttattttttgaacattcaaattatataactgactgttttccacttttcgatagttgttagaaaaattcagcctccacctttatcaactaggcagcacctcacagccaatgtttgtttgcagtaatttcatccctgtctttccctacaaaattcatctccccaaagtttagaaaggctcacctaattatttttagtttgctcttatcttagtgagttgagtgtatttttgtaagctgtttatagttttggagaggataaagatggggtaaaataaatacattctacagaaacatcacttcctgttccagcctgcaatcatgtaatgccagttacgtcagggcagaggttccccacccatgagattctgattcttccacaccgtcctcaccgtctacagtgactgccagttttcaggctctacacacaggtctgtgttcccagtgtctgtcttaggatatgggggagactagttctggggtctaagtcttcagtctgtctgtgttcctgaagatgacttgtaaaaagcgaggtaggatagtagaatctttcatcccttgaccttcagctatcattggcttcaaaaatatctttctcacctttagcaatctcatttttaaagttctttccaaaatgaaattttactccctccttcaataattcatttcaagtataaagtatccaagatttaggaaattctatttgtccctaaccaaagtcgatgtattgctttacattatcattattgttaagactgaaaggtggaagagaaaatctattcattctctcctcattatcttgaagatgactattaaccataaccccagaactaaacatcttaaaaatattcaactcaaggattctttaagtatgtcagtaaacattcaccaggcagtgtatatgaaggaggtgtatacagggttagatagtactactattactggctgtcagttaccttgaatacacttttgcatacgaatttatacattcttcaaaaaataattatgagataaaggctataattatgcctctagcatagatgtggaaactgaggcacagagatttagaaaatttcctgtggtcacaagctttttcaggtgatggaaccagaatccaaacttgggacacctgacaacatagctgtgtaagctctgctgcttgtaagcgccaaggcctatgccagtgaccaaatgtcccctatttttgcagaagtcttttttaatgggtatttattattttctaagaaatcaaaatttcactcaaccgtatctaatataacactgtacattttataagaaatttgtgtattttgatttaataagtgctattataatcacacaattttctattgttttcagggcaaaggaacagtttcagacccgtgcaagcttgtctagactcagctcttcataattatgatttcgtttctatggacagagggaaaaagaaaaacaatttctactttctatatatctgaacttgaggactaccagtaaatacagaatattcataattcatacaataaaacctaactccattttgcatacaactgttcacaactattatttacaactatcagctatcattataccaattatgccgatatggtgatattatattaactatcatattacaactgtcactttcagcagtcatttctccagtacttcaaaatcacagagctaagcctttgtaatatattttctcatttattgcatccgagaacactatgacctagataaaattatcagccctattttacagttgagaaaattaaggatcataaaagttaagtaactggcctgggtttagtgctgaggcagaattggaatgtctttctgctatgtatgtctgacagcaaaaagcatggttttattatagtgacccgataacagatcctgggcccaagggtaattatttttgaacatactatacttgtcaggctctcactgtatgattgccactttgcatcaaaatttattaaaatattttttcaatctcttgctgaacaaattttgcaaaaccaaataaaaagaaagataatgaagcatgtgtgttggccaccagggggtgcaaggtccagcatcctaaatcatgtcctcaactttgcaggccttttcttgtggtatatgaaaaagggaactctcttaagaaaggcatagagtaaatctaaggggttttgtaaatcaaaggtcaacattcgtttgaactacacctggtggtaaattaatatctttgaattatgaaacttgatcgaggatgggccgactgtgataaaaagaaatcaaataaatggaacttctactatttctacactattttcagcataataaaaatttgaaagtgtctggcagaacatttagccacaagagtttttaaggtattgatttctgggagacaatttctcttgatagacggcctacattttaacaatgaccacttctaagggtggtcttgcctgtcttcacgtcaacccacataaattggacagagtggggtatatatgcccagcaaggcaggctgggggctcagctgtatatctttgtttctggaagtactatttctatatctaaaatgtatctgaaggcatgtttccttggaggtataatgcaactattgcctcatacctgggtcagttttgtttgaatatttctgttgtcatgccgattgtcagcatggtccataattatgaagagtccctgattgtaaaataaaataataaagagaaaaatcagtaggagagtgcctggggtgaatttataatgcatttaaagtgtgaagctgtccatttaacccttaacaatattcattttcttcacaatgtgcaaaccttgtcagtagtttgaaaagctatgaatttaaataaccttaagcagcctcagaaatgaataatttgataggtatatctggcagatggttgaaatgtcgaagcttttttttctttttccctgagaacatgctgcagggtttctgccaaacttaggttgtaaggaaggcaaaaatcaaacaataaatgctccatatttgcaaactatcaacactaagatagcatttaagaacagttgccagtccctcctcccttgattctttggtggaatgacctgaaaagcaatacctttttatttaagatgaaattttttagtttgtcaaaataaatattaacctcgactaagtttaaagtcaatggcctactagtggctctccagcttgtctttgtggtttcataaatcttaatgcttatttcaatattaatgtgagtactgacaactggactagcaaactttgattgacatctcattggagggactctagtgagaaagagaacacattttttttttcctctggctgttgttgatataggtagacacacaccttatcttgtacaaataggtggaaaaaaaacccagctgaaaataatattgtagacacaagtcaacacacacctttaacaggatctatttgttacaaaccagtgtctttaccagaagtacagtcaggatgtagagtaaatgttccaataacatctgttgctgtaaaagaggatcctgatataaggatgcctaaaaatgatctaattcatattcagaaaaaaggaacacatacccaaggcttcaaagaccatctaaacaaaaatagcaacatggtagcattctttggaaagtgtcaaggtgggagaagacatttttaagtaagaatcaagaatatgctaaatataataatataaaaggccactaattatttacctgaagttatgttggccttcagagggtatgttaagtcagaaatgattgaggaaattttagaaaacaaaattccaactaattattattagaatgtttaccattcttaaatacttcagaaagttaagataataataagaacaataagagttaaatacatataatattttaaatgtcaaaacaacttatatatatatattttattcaagcttcacatcttaatgacataggtgagcaaaggaagcaagtcatgcaactaatgatcagaattagattacagattttagaattcttaatccaatgtcttttactatgcaaatttaacatgtttataaaaaatcattgtaaaggactttcagatttataattgaaaatgaacacaacaattacctcttccaattacgttaaaattttatataggagaataaataaataagaagttggttttcaaatatttatatttattggtattattatgctaattatcagtatgtctttggtttgagtttgatgtttcaaaacatttatttatattggaattcaaaatgttctataatttgcattgactgagtaggacagtcattgtttctgtcctggtgaagcttctattcttctattgggggagaaaaaccttcaagaactattaatcaattattcaattattgctgagttaaatattttgaaatagagggtaaatagggtttcctgaagttattaaaggaaggagtcagcaactcatctttagaaagataaaatcaagatgagatctgaagaattaattagttttgtaaaaaagcaaagtgggcaatagattttggcaaaggaaacagcatatacaaagtcatagggatttttttccaggggcttataaactttattttttatagcaattttaggttcacagagaagttgaatggaaaatacagagagtgcacatatacccctgttcacctactcatgtaaatctactccactattgacatcctgtatcagagtggtacgtttgttacaactggatgaacctacactgacattattatcacccaaagtccatatgtacattaggattcacattggttgttgtagtacattcaagggtttggacaaatgtataatgacatggatccaccaggacggtatcatagagtgtagttccactgtttaaaaaaccctctgtgctttccctattcattcctgccctcccccaagacctggcaaccactgatcttttactgactctgtagtcttgccttttccagaaggtcatatagttggatcatacaatatgaagtcttttcagattggcctcttatacttagtaatatgcatttaagttttctccgtgtctttccatggcttgatagcttatttctttttatcacgaataatattcttttatttggatgtaccagtttatccgttcaccttctgaaggacatcttggttgcttccaagttttggcagttatgaataaagctgctatacaatccatgtgcaggtttttatataaatgcaatcttcaattcatatgggtaaataccaaaaagcataattgttggatcatttgccaaaccgtcctctggaattgctgtaccatttttcattcccacaataaaaatgaatgagagtttctgttgttccatatccttgccagtatttgttattgtcattgttttggattttggccattttaataggtgtgtagtggtgtcttgttttagtttgcaatttcctaatgacttaaaatgttgaacatcttttctatgcttacttgtcatctatatcttctttggtgagtcgtctttacaagtcatgaggatattttgaggagacaaagcatgtttgaggaacttcagggaagtgagctatagtcaatataataaagggggggaatcaagaggtcagccttgtgcagtggcagagaccacattatgcagatccatgtaaggacaggttaaggattttattgcttgtagtaagagaattgtattactcaatggactaacatgtttcaaattacatagcttggtccaaattcactagcttcatcttccattcctttgtgtattgaaacttcgttctagctaaactgatctactcactaactcttaaatatataatttagtttcccatcatatttcaatttcctctatcattttccttccctaaaattatccatatttcttgaccaataaacgttttttggaaatagagccatccctactagtctgaatgtttgtaagtacttaacacatctatatttcacatactatggttataccactgtgaataactataatagcatagcacatccatgctgaactttaccctggacaacgagtctttgtaatcaaaattttttctagttctcatccagaaagatactgacagactcagaagaagaaaaagaccaggtagtgaattgggatgaatgcctgagtatgtgggcctatccatacatctaaaattctttacgctaagaacagacgtttaaaattaataaatacttagtgcggaagaacagaatactatctgtgtgacggaatgttggaaattcctaaaagatcagaagatatgtatcagatgtatagaagtgactatatccaaaatcatacatagaagagtagttctgcagaggtgggaactttccgtgatatagtaacctcggaagtaatgaacaaatggtataataaaagtcctgggaaatgttcagggtgataatttgagaaatagcacttggagcagcctagaaatttggcctctgaaggagttggtagcataagtatttgcttataagtatgagtaactgtaccttggaagcagagcagtgccgcaaaagatagtttatttcttacagaggttttgtgaaagaattactaatggatatacttaagcaaaataagaaccaatttcatgtaaactcctcagggacagctacatcacattaataagtgcccactcatcaattacaagttactcaataaactaattcaatcatgagtttctgatgctcagcctgtatatggcatttatcttggatccagtatattcctataaggtctttgatttttgcattgtgagaaagattctaccaagggtcaaatatcatgtatttctgataataaaggtcacagaccaccttttaaatttttggcacatcttaactagcagcacctacctactttacatatacagaacattacactcaactgcagaatacatatcattttcaagcacacatgaaacatgcaaatatttacaatatgctaacaaaatgtccagtgaatcgaagttatacagaatatgttctctgaccaaaatgcgctgttaaatcaatgtaaatagataaccataaaatgtccatatgtcagaaactggaaactacatatctgaataatctagggtcagattagtaattaaaatgaaaatgagaaaatattttaactaaatgataagcaaagtgtatataaatctatatttagatggaaattatagccttaaatccatatattaaatggcagaaaaataaagctaagcaaacgcttaactcaagaaattagaaatataaagaaaattaaatacaaagaaatcagaaataaggaaataatatagataaaaacacaaataaaagaaaataagcatataatgaaagaataaacaagtacaaatgttgggtacttgaaaagcttagtaaagtaggtatctgcctaggaatactgattaacaaaaataaagagaagacgcaaataactgatattgaaaatttaagaagggcattagtaaaaatactatggctatgaaaatgaatataatactacaaaaaacttaataataacttttaaaatgtagattttttaggacatatttctagaaaaaacatgaccaaaactaacattaagatatagtaaatctagatgatcttacaaatattgaagaaattatgtttctttaattctatgaatttcaattattctttaatttaacatacttatactaaaaagtttgaggatcagatggtttctgtaggaaattctatcagcttttaaattctcagtttgataatcccaatgtctgacatatctgagtgcaattttgatgttgctttgtctcttttaaccatttagcatgcattgttaattttttaggaaatctggacatgaatgtattgagtaaaaaggactgaggtagataggcttttggtgtgaaatttaacatttatgtcaccagcaatatgtgtttactgtttgctgtgtcttgtttttatcttctctgttgtctatgggcttttctagaacctccttaaatagggtttgtttaaggtttgcagttcttttggctgcaatggttgctactatataagaatcctatttgataggggtggagggaggggaagtgtcgtgtgattaggtctcagtctttctgcaagcctgtgttggatatccatttcccttcgccgaagttggttagactctggtaaaaccccagcctctcaggctctggtaagatagttcccttgaggacgggtcttgttgaggagaatagagacctctggatatatttcgaaatagttaattttccctccccactgccggaagcaaaggggatgattctccaatcttcacccagagaaccaggtaaagctcctggaggtaatagtcatgaaagtgtgagggttcccgctaagattgagtcccctagaactctcaagctagttcatagtgagacaccagcaatttgtcaattgcagtttaaagagttcctaccacattggctttagctgcagggttccgctgctgggctcctgctcacaaaaagctctaagtctctgtgtctgcctgtctgtctctatagtttatagagcagaagttttctgtgtaacctcaattctcagatgtatctaagaagagtggttgattttcagtttgttcagcctttttcttgtgaggataggagtaaagacttccaagctctttacatgggccccaaactagaagtctattagcttttcaagatataaatattaataatattacataaacacttttagcaaataaagctgtaaaccactcaataattttttttttaactccgtcgcccaggctgggatgcagtggtgtgatctctgctcactgcaacctctgactcctgggttcgagtgattcccctccctcagccacccaagtagctgggaatacaggcgcatgccaccacacctggccaatattttgtatttttagtagagacggggtttcaccgtgttggccaggatggtcttgatctcctgaccttgtgattcacccacctcggcctcccaaagtgctgggattataggcatgagccactgctcccagccaaccacttaataattttatgaggccagcaaaatacttaaacctgacaaacaagctgaaaagatattccagaccaaaaccacaatttatatagacatacccactaaaatataatagcagaaaaaatttcagaaatatccaaatgttgataatagcacaaataagctggattcgataccaaaatcctaagataatttaatatttaaaaatcaatttgattcaacatatttactgaatagtgtggaaaatatcacatgagcattgcagtagatacagaaaagcattgataaaattcagtaaattttcattaagaaatttgcatgcaaagttaaaaatagaaaagaattcccttatcatgggttaaaaaatatatttaaaaatctatattataaaatccatatataaaatataccaaaatatctataacatatattatatctaattggaaaatattgaatgccttctcttttaaataaaaaacaaaacaaggtacccaggaacaacattcttttcaagtctcaacttgatgatgtagtaaaacaaaaacaagcaagcaagcaaactaatatgtaatataaggattagagaggggggaaatgaaactctcattgtttataatgatataagtgggtttacaaaatccaaaagaatccacaaatacattattaaaataagttagtgagctgaaaaagtttactcaacacaatttactttgataccactaacaaaatgttagaaaataaccattgtgtaagtcagtgtggcgattcctcagggatctagaaatagagataccatctgacccagccatcccattactgggtatatacccaaaggactataaatcatgctgctataaagacacatgcacacgtatgtttattgcggcactattcacaatagcaaagacttggaaccaacccatgtgtccaacaatgatagactggattaagaaaatgtggcacataatacaccatggaatactatgcagccataaaaaatgatgagatcatgtcctttgtagggacatggatgaaactggaaaccatcattctcagcaaactatcgcaagaacaaaaaaccaaacaccgcatattctcagtcataggtgggaattgaacaatgagaacacatggacacaggaaggggaacatcacactctggggactgttgcggggtggggggagggggaagggatagcagtaggagatatacctaatgtaaatgacgagttaatgggtgcagcacaccagcatggcacatgtatacatatgtaactaacctgcacattgtgcacatgtaccctaaaacttaaagtataataataataaaagaaaagaaaagaaaaagaaaataaaatgttataacagataccttttaccatagcatcaaaaaatattaaatatccaagactgaatctaacaaaaagaatggaagatatatatgtatgaaactataaagcctttgatcataaaatgaaccaattaaatgaagttatatatcacattcatagatgaaagccttaatattatgaacagcattcttcttaaactaatccatagactctaatccttattttcttatttctatccttattttcttaaatctacatatgtttggtgaaactttccaacatacttctagaattcaactatcccagaagggagtctgtggagaagtttgcttggaaggcctgccatctattcctttttctagaatcgtatttgttcactttccaagatggggcacttaattatgtgcagagttcctttaggtttcaaatgtctcatgtcatccaggataaactacatgcttgggatgtgacaggaaaattattcactgggtgctgatattctgcatttctcttggctctcccaagcagtcattttcaaactacgtctaatagtgaagggatgtccatactctacatctgcctcgctctaaattgaaagacattggtcaattatttcctggatttggtagacttactttttcccatttgactatgctttgaagcatgcatcagatcctcaccaaactatacaaaaatttctatgaattattagatactactttctctatgtttcaaacaaaacttttcaaagattttgggataaagttggagtctaccttttttgcttaataactgttgatattttttgctagttctaattcagtttagaccactatgttggaaggggtagaatttcagatctgctcttttggtgtagtttgcatccacaagtgtaaatactgatattttaacatgatttttagctagtttattgtgataattatcttacaaaagtagacctaataaatgccaattgtataaccaggccacattaaacactgcaaaaaattcaaaatgataaacaagaacatgcttttagcttgaagaaaatttgaatcattagtttaactaattaaatatttctttcttcaacacaaatgctccttgacttatgatggggttatgtcctgatataccgattataagttgcaaataccgtactttgaaaatgtatttaacctacagaatatcatagcttaacctagtgtactttaagtatgctcaaaacacttacattagtctacgatcaggcagaatcatctaacacaaaacccattttataacaaagaattgaacatctcatgtaatttattgaatactatacagaaagtgaaaaacagaatggtggttgtgtattcaaagtatggtttctacagaatgtgtattcctttcacaaaatcataaagttggaaaatcttaaatcgaacagtcatgagttgaggaccacaatgcagggaggagagacagggagggaaagaaatagggtgagaaaaatagaagaaaggcaaaggagaaaaagaaacagagtgggaaatagggagtgagggagagaagaaggaaggaagagaaatgggccacagggtcatttagtctagaaataaatgtcattttattttattaatcaacactcagttaatacaattgttttagatgggaaaggcttccctgcttgatttcacaagtgaagaattaaagttttgctgtgataaaaatgatttaaaagtcattctggctgtaactgtgaggttggaagtgacaggatgtttataatacttgcttggatgctttacacatgaattaagcctacgttaaaaagataataatatacattccacgtcatttagcaatcattagaaagaacaagaaaggctacagaaatagctttaatattccctcttccccacccgactagaaaaaaaagaatgaaatgcacaaacaaatttaataacacatacacatacacaacaggcaaactggtctcttaaaatctaggggcaaatggcaaagaagaaaggcaaaaaaaaaaaaaaaaaaaaagattgcatggcacattcactttttttccctattctaactagattattgtttacaatatggtatttaaggactctcatatctaagttacatttcccagcacaaaagcaaattattcttttgcattactttaatactttagaacagtatgcattgcattgagaccttgtagagcaaggtgttacatttaaatctttgatctccaaaaaaatagcaggatcaaagttttccatcatttggacataaatctcagctcaaacaaagtgataatagtctagtcaagaaaaagcaacctggaacaaatgcctttgaattggtgttagtctacgtggttggtgcattactgaattaattaatcatttctttgaacttcgatattctgctgtctctaggttaggagtaaatgtcagtcactgttcatctatttgaaattcattctcaatactaatattttgtaaatcaaaagagaaaagagttaaactttgtggctctgggaaacatattatggggaaagtttatgatgtaaagaaatgcacacacaaaatttaacatctttactgctctcaatgagaaaattcttatcctaattaaaggactgattgaatttgtggggtttttttattgttgttgaagttaatttgattgcctactgtagtaattaatgtagttattaatgtgaaatcaagcaggttgagcagaatcacagctcttccagttacttgttacttgaacttgagccaattacatgacctccctaccacacaggtgctccatttgcaaaatggggatgttaatagtacccatcatataaggtggtcataagcattcatgagatagcagttgtaaagtgttttccacaatgactgattatgcaatacttcctattcataattaataagtatatcactgatattttaaaagtattcatcaatgacaggagttttaaagcttgttctgaggatttatggagagtctgtggaagagttaataagcctggaatttcctatcctgtgtttcaaagagtgcagttctattcttacctctttatatatttttaaaatgagatttaacatattcaaaagtagtgagagcattataaaaaaatctcctatgtacctatcacccatttttatgtaattaacatttcaacatattttattgtgattttcttcataagatttggcttgcaaagatttatgatgttaaaaattaatttgaaaaccactgacttatagactaaatatattctagcaaaaatgcgtgtttccttttttcttttctattttttattgatatatcactgttgtacctattttgggggaacatgtaacatttcaatacatgtatacaatatataatgaccaaatcagagtaattggggtattcatcacctcaaacatttatcttttctttgtgttgagggcattacaattcctctcttcaagctatttgggaatatacaataaataactattaactataatttccctactgtgcaaccaattactagaaaatattccttcaatataatcgtatttctgtacccataaaccaacttccatacaccctccctgccccttctcctcccagcctctggtaaccaccattctactccctatctccatgagatccacttttttatctcccacatatgagtgagaacaggtgatatttgtctttctgtgcctggcttattttacttaatataattacctccaattccatccatgttgctataaaggccaggatttcattttattagatggctgaatattccattgtgtttatatacgacagtttttaaacccatttgtgcattgatatacacaggttgattcaatattgtggccattgtgaatcgtgctgcaatgaacataagagtgcagatatctctttgatatcctgatttcctttttttaaaatatatacttagcaatggaattgctaaattatatagcagttctatttttaccttttttggggatttacatacttttttttataatggctgtaataattcacattcccatcaacaatgtataaggttctcttttctcaccatcctcaccagcatttgttatttattgttttaacaatagccattctaactggggtgatataatatctcattgtggttcaatttgcacttcctcatcgtaattctgagcatttttaaaatatacctgttggccatttatatgtattcttttgagaaacatttattcagttattttgactattttttatttagactatttgtgaggtttttgctattgagttggttgagttccttatatattttggttattgatcctttgtcagtttgacatattttttccattctagaattgatctttatcaagacccatgtcctggagaatttcaccaatgtttccttctagtagatgcatagtgcaggtcttacatttaagtctttaattcattttagttgattttttgtatgtggtgaaagatggggacctagttgtattcttttgcatatggataccagttttctcagcaacatttattaaagagactatcttttttccaatgtatgctcttggcgcctctatcaaaaatgagttggctgtacatgcaggatttatttcctgggttttttattcattgatttttgtgtctgtttcattggtttaggtgtctttttgtgccagtaacatgctgttttggttactctagctttatagtacaacttaaaatcaggtaatatgttgcctccagctatggtttttttttttttttttctatctttttctccttttttttttttttttgctcagggatgctttagtcatttcagggttttcatggtttcatgtgaattttaggactttttttctatttatgtgaagaatgtcattggtattttgacagggattacattgaatctatggatagcttcgggtagtatagacattttaaccatgtaatttttccaacccatgggaatgtccttcaattttctgtgtgtgttcacttcaatttcttttatcaatgtgttatagttttcctcttatagatcttttacctcattggttcaatttgttcctaggtatgttttggtagctattgtaaatcagactgcattcttgatcactttttcagactgattgccctcaatgatctccatacctgttttattgcccttctataatccattctcaatgcatcaacgtgaggaatcttttataaacataaatcagatggcatcattccctggctcaaaatcctagctttctctgaatgcagtccaaattcatcacaagaccccatgttatctctccctccccctcctcacgtggtactcttttctaattcacagcactccaaacacatggatttgacaatgccattacttttcttcaaataagcacaccaaccttgttcctgtcttaggactttgtgtttgtttttccctctgccaggagcacttttctgtcagattttcactctctgtagcctttcatttcacaggtctctgcctaaatattgtctccttgaagagtcctttcttgaccacctaatctaaagcagtcaatctcctttcccagtcactatcacaggaagaccttattgcagttctcacagcacttattagtatctgaaattatctttctagtttattgatttcattttgtcttttttctctcatataattttaataagatgatggactttgactcttttgttaggtgaattttccccagtgtctatttattggctgatgcaataaatatttgttgggacagtagttaaatgaataaaaatattattaaatagggggtgtggaccactgtccttttaggccagacttcaccctaattgtagttccatccatttttaaaaaagctttatttaattactcatttcatttccctaagccattttctcttttaaatagaattattataagatatgttattcctgggaagatggcatgaaatgacatacaacttattctccattcaccactctactgcaccctggatctaccagatccatttcccactctactgcatcctgttctgtgctgtgactggtatccataatctgtattacctggatccattttcccttaagctcctccttgagatccaacaataggagaactcctccacttcccctattttcttttccagacatgttttctttaccagctgactctgaatgtaataacagattctgcctggctgctttttcccttccaagtcccagctcttatcaggcactggcaatgccattctttcttcttgctttccaggggagctaaagtcttccaactatttttagtacctggatgccttattgcccatatgtttataaatagttatttccttaattaacttaagctaaactctttcaggtgagcatttgtctcttgccaggaccatgattaacactgatactgtctgtgggcattttctacacttcccagaaacaatttattttaacaacatttattgaatgccaattgcatatcaggcactaagtaggcactcagcactatgtgtatctgatatatagacataagtgtcataatgatgatgttttcattaaacaagatagcaagtcttttaggcataattaaaaatcaaaatataacatcattaaattaaaatgtgggttaagaaaatgcagcagaagatttgtgttctggtgagtcgctgcttcttttgttagtgtttctgttggttttatgcacatatcacagaaatagaaaatatatacatatttacacgcatacacatacatacatatataaataggcttattcatgcttgatttgtgtgcaaagctgcatcttatcaaacttcacagtcaattatatattcactggcatgatctacaaatgcattaatgaatcagataaggcaaatacaataaatgcttatttattttcattttatccagcagaacttgctggtaatcagctacctgtacatccacactgcggtaacatttctacatattcatggcaggcagggatcagatcgttgattttcaaggtctctgactcagtcagagttctgaggttccaaacccagacccacatcttactagacttttgccttggataagctgctaaaactccaaacctcatctataaaaaatagacagaaataaacaatagtgccagtctcattgaatagggctgttgtgagaatcaactatgttaatgcatttaaaatgcttatcaaaagaacatggtgaatgcttaaaaagtagttgctactagtgtaattgttattagtgatgatcctgagactgcgtaaaattctgaaagatattcagaaacgtaaaatttgtagtctccttatttgacatagcatgtggctcctgatatctattctacatcaaacttctttgaactattctatatgatcactgtgtgttctctgtagtctacacatacacacacacaaacccctataaaatatatataaatatatttctgatttttttttttttttttgagacagagtctccctctgtcacccaggctggagcgcaatggtgtaatctcagctcactgcaacctccacctcccgagttcaagcaattctcctgcctcagcctcctgagtagctggcattacaggcatgcatcaccacgcctggctaatgtttatatttttcgtagaaacggggtttcaccatggcggccaggctggtcttgaactcctggcttcaggtgatccaccagcctcggcctcccaaagtgctgggattgcaggcatgagccaccacccccggcctatttgtgattatatatggagacttgattgaccaagtatgctacctttctatcaatccagcataattacctaaactctatagctctctagtctgtgaataatctaaagaggtagaaaagcaacaattattgctgaaatgggagtgaggctaagtaagcttgcctctttcatgaaatcattaggaaacatgaatagatctcttctctgtgatctcttgccttcatctctcaccaaagtaaaggatgtgataaagtaaaggaagtgaattagacattgtgattttcaaagagttgtccataaaacacttcaacaaggcttttgggtaattcttatccatgctgagtaccggatagaaaatggtctaaatggtatcttctaactgtattcttcagtgatgcatgtcaaaccattaccactacattaggaatatattcctgttaaactggcgactgcccatatgggaaagagaaaacggacactggtctaaaccattcagacctttctatgttaaaactgttactatctaccttatctttaactgttgtttttgcatcatcgcaattttaacatccgcaaaaaagcataggcttaatggactgtgaagcagtgagccaatcacaaaggcaacaaaaaattcaatcacaaacacctgcaactcattacaaatttagcagcacaaatgccagaggctgtaattggtctcaggtagtctctgcaactctgccaatactcacctataatttggagttgacatttacaaaaaaagacaacatttacaaaaagaaaagggcaaagagttttaccaaatagtgccactctttcaacttcccccttcctgccaagacacctcagggagaaaaagatcaattctaaatacaggtgctatttgtattccttttggagtacttatgaaacaaaattaattaatgaagaatttaaaacaatattcactaggaaactgggaggtattttattttcctccagaaactaacattctctacaagtatctctagtataaaaaaaaaaaaatagggacaaaagagagaaagaaggagggggagtggaaataaaaataatgtcagttttatttttagatttcctttctattttgatttaaggattaggtatagtcagtaaatatagacttaaaatcttgcaaatgaggactgttacatttgcaaatatggaacgttttggttgtcattttgtggagtgaaaagaaaaaaaatggaacataggcatctggagagttgaattctggtcctggatctgtcactggttgtataacattggagaagttgtttaactccttgagattctgtttcctccatttaaaattttgaagattgcaggctctggcttgatatccctctcagcagcttcagtttctgagcaagaactctccatcagatgcaagccgtaaaccgttaatttttctccccacatttcctttgacaatcactctcttctttatttttcacagcataagcctgatatacagacactgtcatttggaacagaccctttaaagtgcctactgctaacgcacctgctatcttaaggagaaattctactttgtacctcattctgtgttttaaaatgttagcaagatttttcctttctcattctctcagaacattttggaagttgcttcctttcagtgacatttgatgttaattgaggaatgcaaactcattttaatatcggaaatataaacagaaaagtagccttttaataatcaaattgtaaataaataaaatattttagtgttatgcttggcatggtagcccaacatttacaagcattattgaaagttttgtaaggaacaatgatttgtttcttacaaatacctgatttctcaactgaagtcactctcatttcctgtcccgcatgttccataacattttttgtcattttcttatactacaactaacaaacatgcttaaaattaacaaacaaacacctttcttaagcaaacccttcatctagcaagtatgctgctgaaataaaacagccctgaacgtctatgacttaggagccttattctcttattttaggtatcatatcaaacattcataactcatctagaagattcacaaacacaggtcattttcacaaaatttcctaaattgccctttctttcttcacctccggcagtttggaaaggtcctcttttcaaaaaaaaaaaaaagtaatgcatgcaatatcagagtatccagggtgcagtgtgacaatcaggtatgaagcgaagaaaaggaaatagaaatgggagaagataaccaaaaatgactagaggttatgtctgtctgtttgtcttagtcttctctggctgccataacaaaatagcacatactgggtggctcaaaaaacaaaggtttattttctccgcactctggaaggaggttggaagtctgagatcagggcaccagtatggctgggttctgagtatacccttttaggcttgcagacagataccttcttgctgtgttctcatatgttgaagagagggaaaaacaaatctcactctcttttcttcttcttaaaagaccacagttctactggggtatgtcgccaattttataacctcatacaaccttaatttcctcttaaagatcccatcctcacatatagtcacattggagcatcaaaatatgaatttagaaaggctacaattcagtccatagcactattattataaaataaggaggagaaacattcacaacatgtatttaattaaaaaaaaaagttttataaacaatatatactgatgttatacatatatgtattgtatgtatatatttgtatggtatatatacacacatgcatatatatatacttatagaaaaattactaaaatatatttggtggttacttctgggtgatcagattatgagtgatacctaattcatcttagttttcacttaaataatttcctaaaactgggaaaaatactgttaataaatgttacctcaatgaactgacatactccggaaaataatctgctaacttttatagtgatttataaacctttaactcaggtcactataagtgaaaatatttccctcttcaatgaactcgcaacctcagaatgcatttgtgagttctcttgcagtgtaaattatgagattattcctaaccttgtcaggttctggtgacatactgcctaccataatataatagaagcaattcataatttttttttttttttacctgaactagtttcaagttctgtggctttgcagctgccattgttcctgcttcacacagaacattcggtacaggggatactttatgggacagaacagatagttgaaagctgattttacttgctaattctcccttgttattctggcattaaggttgcattagaaggatgcaaagatgtttgatgaaagtgatctgtgctggggttggtgctctgcaaatgctttaaaggtgtggcacatgacattgagccagtgcatccaggtggagcctgggacagacataaaaccctaggttggtaaacacctgtcacaggaagcctcatcaaggaattcttggggagtggaacagtggagcaccctgcaatcctcacaggcagcagccatagtaagcaatgttcagcatttgctgtgcctcagagacacacacagcataaccctacttcagcagctcactgcagaaaatgaaccatatcccaccaaacgagcagtcaagtgcttgctaaaggacgttcccaaagagtattgttctgagcccaaggtgtgggctgttgggttcaggtgtgagaaacagacagaggcagggcaaggctgttggtatatactgttccaggaacaaatctttcccaatttaaggcactttatattgcagccaataaactcttttagtagcatccggttttgcttcatgagtgacttctgaaataatgtgtgctatttttaatactcaatatctgtgtttgccatgacattaaaaagattcagaaacaatgggttaaccaaacggcattttgtcattatctaaattcaacccaattatgagaaatgaaagcaaagggaaaaagtttaagaaatttggtagtaaagtaagaattattaaatattcagagtcaatgtctctccccacttaactggctctttgactaacagtttaatcttcacatggcttaaaattcgattcatttagtacctcctctgctgctgagaaaaacctggtgcacgtggtactctaagatggtctgcttcatcttcaatcacacactaccctggctggcagcttacctcatcactgggctaagagactttgaagagtatttatttcacattccactaattaagctgcgtatgtgaccttactaatcaaaggttcaaaagaacctgaagaaaaataatacattgtttttcaaaataatactgtctgagtgagagttagtataaaggcaaaagtaaagtcttagaaaagattttcaggtggtgcaaatattcttacctatttatataaccttacaatctcttattatcttgatcagaaaattagactaagtatttccatcacaaaagtgtctggtgatcacagaggaggtgtggtatgtctaaatgacatcatcagattcacttttgaaatatcatatgttataaacagtgctaatatttcagtagtccacattggagaaccctttaatgggttggttgactttctctatgaaagtacaaacacttattagcatattcaattatattatcaatacagtttgcttcaaaaatcccaaactctttttctgtttactctatggatttctatttataatatgcttttgttgttctttttagattcaatcaccttggaaagccatggcggcagcagagaaattgctttatcaatattgagatttatttctttataaatcacgatcttatatttactgccttttcttaggcttaaatgaaggataacagaaacatctaaaaatcttaaattatttgagttttattcacttttctttcttctcctacccccaaggcatattataatattaaatctcataaaaagaaggaagataatgtattagtccatttttatgctgctataaagatactacccaagatagtaatttataaacaaaaggggtttaattgactcacaattccgcatggctgggaaagccccaggaaacttacaatcatggcagaaggggaagcaggcaccttcttcacaaggcggcaggagagagaaagagtgtgtgtgggaggaaatatcaaacacaagtaaaagcatcaaatctcatgagaactcattcactatcatgagaacagcatgggggattccacccccatgatccaatcatcttccgccaggtctctcaacacctgggattacaattaaagatgagatttggatgggacacaaagcctaaccatattattctccccctggaccctcccaagtctcatgtcttttcacatttaaaaaccaatcatgccttcccaacagtcgcccaaagccttatcttatttcaatattgcccacagtccatagtctcatctgagacaaggcaagtttctgctgcctatgagcctgtaaaatcaaaaacaagttggttacttcctagatacaaaggaggtacaggcattggataaatgcttccattgcaaatgtgagaaactggtcaaaacaatgggctacaggccccaagcaagtgtaaaacccagtagagcattcagtaaatcataaaactccaaaataatcttattggaatctatgtctcacatctaggtcaggctgatttaaaaggtgggcttccatggccttgggcagctctgcccctatggctttgcagggaacagccccctgccccagctgctttcacggctagtgttgagtgtctgtggtttttccaggtccatggtgtaagctgttgggggatctaccattctggggtctagagaagggtggccctcttctcacagctccactaggcagtgccccagtcaggactctgtgtgggggctccaaccccatgtttcccctttgcacaaccctagcagaggttccccatgagggctccggccctgcagcagacttctgcctgaacatccaagtgtttccatacatcctctgaaatctaggcagaggttttcaaatctcagttcttgtcttctgcatacctgcaggcccaataccatgtggaagccaccaatacttgggggttacaccttcacagcctgagctgtaccttggccccttttagccctggctgctggtatgcagggcatcaagtcctgaggctgcacagagcagtggggccctgggcccagcccatgaaaccatttttttctcctaggcctctgggcctgtgatggaaggggctgtcacaaaggtctctgacatgctctggagacatttttccccattgtctttgctgttaacattctaattaattctaattctaattctaattctaacattctaattctcattactaatgcaaatttctgcatcaggcttgaatttctcctcagaaaataggttttgctcttctatcagatggtcagcctacaaattttccaaacttttatgatctgtcacctcttgaatgctttgctgcttagaaatttgttcttccaaataccataaatcatctctctgaagttcaaagttccacagatctttagggcaggggcaaagtgtcactagtctctttgctaaagcataataagagtgacctttactccagttcccaataagttccttatctccatctaagaccatctcagcctggacttcattggccatatcattatcagcattttggtcaaagcattcaacaagtctctaggaagttctgaactttcccacatcttcctgtcttcttctgagccctccaaactgttccaacctctgtctgttacccagttccaaagttgcttccacattttgggtatctttatagcaggaccccactctctatgggtaccaattgactgtattagtctgttttcatactgctgtgaaaaaatcccttagactgggtaatttgtaaagaaaagaggtttaattggctcacagctccacatggctggggaggcctcaaaaacttacaatcatggaagaaggggaagcaggcatgtcttacatggcagcaggtgagagagaagtgcaagcaggtgagacaccagacacttacaaaatcatcagatctcaagagaactcactcactatcacaagaacagcatgaccatattattgaaaaatggccccatgatccaatcacttcctaccaggcctctccctcaacacgtggggattacaattcaaaatgagatttgggtaggaacacaaagcctaaccatatcagataacatcatggttcctaaggctttgtttttatttgttaaggttcagaaaataataatccaaagtatgatgttttaacatgctgaacactttgaattaaggacattaaaaggccttagaaactgcctcagaatcaagacctctctaacctttcctgtttctaccctgctaagtgcagggaggggccctctttaaagttccattatcctgactgaggaaactcttccaaaagaaatgtcattatcttggaacccctttcctggaatctatattaaccggaggagtttaactcttattgctagagaggaaactaaaagtctccatgcgcagaagaccatatctggacagattttttttttttttttacctgttctttcaactattcttctaagagtttttagagagattttatctgcataataaaacaacttttgttcacagtgcaattccacccttacctgcccataactgttgccatatcccctagagcccaaagaatctttgttccaggctattgtctgatatttggttccattcatttcccctaaaactcatttactcttcctgtaaaattgtccacagttcccacttccctcccactatgaaatgggtattcaatccaacagtttggtcctactttgagtctcatttattgttgttgctgtttaataagtaaatgtattgtgttcttctatgactaccctctaatttctttgttttttaaaagaagattttgtgagtacttagtaggatgtttatatttatggggtacatgaaatgttttgatacagacatggaatgcaaaataagcacatcatggagaatggggtatccatccctcaagcatttatcctttgagttaaaaaaatccaattatactctttaaattattttaaaatgtacaattaagttgttaagtgactgtagtcaccctattgtgctatcaaatactaggtcttatttagtctttctttttttatataccaattaaccattctcacctaccacattcagccccccactatgtttgccagcctctggtaaccatccttctactctctatctccatgagttcaattgctttgatttttagatcctacaaataaatgagaacatgcaatgttggtctttccaagcctggcttatttcactgaacataatgatctccagttccattcatgttgttgtaaacgactagatcttatttttttatggctgaataatagtccattttgtgtacgtaccacattttctttagccatttatctgttgatggacacttaggttgcttccaaatcttagctattgtaaacagagctgcaacaaacataggagttcagaaatctctctaatataatgatttcctttcttttgactatatagccagcagtggatttgctggatcatatagttgctcaatttttagtttattgagagacttccaaactgttctccatagtggttgtactaactaacattcccaccaacagtgtttgaggattcccttttctccacatcctggcaagcatttgttattgcctgccttttgtataaaagccattttaaccattttaactggcatgagatagcatcttattatagttttgacttgcattcccctgatgatcaatgatgttagcacattttcatatgcatgtttgccacatgtgtgtcttcttttgagaactgtctattcaaatcttttgcccttttaaaaatcagattattagatttttttcctacagagttgttggagctcctcatacattctggttattaatcccttgtcagacatgtagtttgcaaatattttttcccattctgtgggttgtctcttcactttgtggattgcttctttgctatgcagaagctttttaacttgataggatttcatttgtccattttttgctttggttgcctgcacttgtgggatattgctcaagaaatctttcactgatgttttacagttttcattagtgagatctttcacttctttggttaattcttaaatatttaattttatgtgtggctatttaaatggaattaatttttatttctttttacgagtgttcactgttggcatatagaaatgctactgatttctgcatattgattttgtattctgcaacataactgaatttgtttatcagttttaatagttttcttgtggggtctttaggtttttccagatacaagattatatcattagcaaacaaggataatttgaattcttacttttccattttgatgccctttatttgttctcttctgtgattgctctagctaggacttccagtactatattgaataacagtggtgacagtgggcatccttgtcatgtttccgatcttagaggaaaggctttcagtttttccccattcagtatagtacttgctgtcggtatgtcatatacggcttctattatgttgaagtatgttccttctatccccaggttttgaggatttttatcatgaagagatgttgaattttaccaaatgctttttcagcgtcaatcgaaatgatcatatggtttttatccttcattctgttgacatgatgtatcactttcattgattagttatgttgaaccatcctcacatcccagggataaatcccacttgattatgatgaatgatatttgtaaactatttttgaatttggtttgctaggattttgttgaggatttttgtatcaatgttcatcagtgatactggcctgtaattctattttttaatctgtctttgtctggttttggtatcaggataatactggcctcatagaatgagtttggaagtatttcctgctcctttattttttttggaatagtttgagtagaattagtattagttcttaaaatgtttggtagaattgagcagtgaagccatcatatctcaaggttttgtttgtttgttttgttgttgttgttttattaactgggagactttttattatgactttaatcttgttacttgttattgctctcttcaggttttggatttcttctcagttcagtcttggtaggttgtatgtgtctagaaatttcttcattcttctagattttccaatttaatggcatatagttgcccttactagccactaatgagcctttgaatttctgtggtttcagaagtaatgtctcttttatcatttctgattgtatgtatttggatcttctccctttttattctcagtctggttaaaagtttgtccattttgtttaacttttcacttctttgttttctcagtctggctaaaagtttgtccgttttgtttaacttttcaaataaccaacttttaattttttctattgtctttttcacttcatttttatttatttctgctctaatctttattatttcttttcttcaactaattttgggtttggtttgttcttgcttttctaattctttaagaggcattgttagattgctcatttgaaatttttcctcctttttggggtagaaacttatagctataaatttccctcttagtgctccttttgctgtattacataggttttggcatgttgtgtttccattatcatttgttttaagaaatttttcaatttccttcttaatgtttttcatttacccactggtcattcaggagcatatagtttattttccacacattcatatactttgcaaaattcctcttgttattaatttctagtttaattccattgtggtcagagaagatacttaatattatttccatttctctaaatgttttaagacttgttttgtgacctaatgtatggtctattttggagaataatccatgtgcagaggaaaagaatgtgtattctgcagctcttagataaaatgttctgtaaatatctattagatccatttggtctatagtgcagactaagtctaatatttccctgttgattttctgttgggaagatctgtctcataataaaagttggatattgaaatctcaactattattgtattggggcctctctctttacccataagaatattccctttatatatctgggtgctccagtgttgggtacatgcatatttaaaattgttttattctcttgctaaattgccccctttatcattacatagtgaccttctttgtctcttgtatagttttggtcttaaaatctattttgtctcatataagtatagtgactgctgctattttttggtttccattagcatggtatatcttttaccttcccttttatttcagtctatgtgtgtttttataggtgaagtgtgtttcttgcaggcaacagattaatgggtcatctttcttaatccattcagccagactacgtcttttgtttgaagcatttagtcaatttatatctaaagttattattgatacataaggacttactcctgccattttattatttgttttctggtcacgatttccatctttcttttcttcctaccttcctctactgaaggtgattttctctagtgatataatttttagattcctgctttttgtctattcattgtatgttctttggtttgaggtcactatgaggcttgctaatactatcttacaaagttttattttaacctgattacaacctaacactatttgcataaatagacaaagaaaaatagactaatacaaatgccacagcttaatttcaccccccagttttttttttttaactttttgttgtttctatttatatcctcttgtaatgactatgtcttgaaaaattgttgtagttattatttttgattggttcattgttgagtctttctacttaggataagagtaatttacataccacatttacagtgtataatattttgtgtttttctgtgtttttacacagaaaacccaagagttttatgccttcgggtgattacatattgctcattattgtccttttctttctgatagacgtatttcctttagcatttcttgtaggacaggtctggcattgatgaaatccctcagcttttatttgtctgggaaagtgtttatttctccttcatgtttgaaggatagttttactggatttcctatcctagcataatttctttttccatcagcattttaaatatgtcataccactctctcctagcctgtaaggtttccactgaaaagtctgatgccagacatattggagctccattgtatgttatttgtttctttcccttgctgcttttaggatgcttttttaatcctagaccttttggagtttgattagtaaatacattgaggtagtcttctttgggttaaatctgcatggggttttataaccttcctgtacttgaatactggtatctttatctaggcttgggaagtttcctgttattaactttttgaataaactttccatatctctttctctacctcctcttttaaagccaataagtcttacatttgctgttttgtggatattttccagatttttcagatgtgcttcattttttattattttttcttctctgattgtattgtcaaatagcctgtcttcagctcactaattctttcttctgcttgatcagttctgctattaagagactgatacattcttcagtgcgtcaattgtgttttcaaccctaaaatttctgcttgtttcttataattattttaatctctgataaattgatctgatataattctgaattccttccctgtgttatcttgaatttattcaagttccctcaacatagatattatgaattctctgtctgagaggttacatatttctgtttctctatgattggtccctggagacttatttagttcatttgttgaggtcacgttttcctggatggtcttaatgcttgtagatgtctgttatgcctggacattgaagagttaggtgcttattatagtcttcactgtgtaagtttatttgtagctgtccttctggggaagactttccagatatttgaaaaaaattaggtgttgtgatctaagatgtttctgctttagggggcaccccaaacccagtaacatcatgattcttggagactcatagaggtactgtcttgatggtcctgggcaagatctggaagaattatctggattaccaggcagactcttgctctcctctcttactttcccctaaacatagtttatctgttctgagccacctaaagctgggggcacaaaacacaaacactcctgtggccaccaccactatgactgcattgggtctgacctgaagtcaggacaacactgggtctcacccaaaatctgttgtaactactacctgggtaatacctgtgatcactcaagtccctggacttctaaaatcagcaggtggcaaggccagacaggcctttgtcctttccttcaaggtgatgtagtccccgaggtgctgggtggctccatacgtgtcatcgaggagttagggaatagagtaaaaaaccttagtgtctacctggtattctattgtattgcagctaaaatggcacacaaaccacaacacacacttcttcccatgcttccgtcccctttctaaagacagaggagcctcactcggtagctactgccaccccaggccacaaagagtactgccagactactgccaatgttcccttaaggcccacgctttcttaagtcaacttgtccttaatgctggctggcctgggcttcacccttcagggcaacgggctcttctctgttccacagtaggttcacaaatgccatccaagagtcagttcctgcaactgaggacttcaggagccctcttggtgctgtacccatctgtggccatgctagtgcaaagtcatagtccccttcacttttccctctgcttttctcaggcagaaggagttttaccccagagccaccacagctggtaataagctgagtctcacctcaagccagcaagtttcagaggcttacccaagacccttgatatagtacctgggtatcaaagctaatgattcagggcccaatcagatgatgaatgcttccaggactgggtcattttcttcaagcaaggggttcccttctgacccagggtgtatctagaaatgtcatctggaagctagagtctggaacagtgccttcataactatgaccagtaccctatcctcctgtgactgagctggtatccttggtgcaagacaaagtcctccccactctttcctcgcctctctttaagtggaaggaaggtctctttggagaagtgggccatgcagcctggagtggtaatgccagcactcccttggctaccccaactccccggtccactgtttctggatctagttcagcactagggctcacctaagttttgcagtctttgtggcctagactgactttcaagtttactgggagacacagaatgctgtagccctcggtggtgaagtttgcaggcactcaagttcagaccactgggatcggtttttctcctctggctagagctggtttaaatgctcccttccttgctggggatcagctgagtttggtctgcttttcccttctgttctaataggacagcactaagtttcgtgcttcacaatgtaccagtaggtagctagtcaggcctgatcagggcaagagagtgctccccacaacctaacaggaatgtcaagtgaccatcacatgacggtcaggcagctgtcacaccgtttctccaaaataataattggtagcagccagcaccagggaaaggcagtatcacaataaatagaagcacctgaaactaatgatcagtagcttcccaataagctctcaagaattgggcaagtgaactcaagcatgcgcattaagaggcaaaatggcagaatttaactggtatatgacctcttagggatgttcaactggtaagagaagattgcttcaagtgagggtgcatgcaattccagtaaacacactgagcatgctcccctcccaagtgcttgcaggccactgtgcatggacagccaaccccaagggaagaatcaggggagaaagaactcaagacccagaagtacgaaaatgcataaaaccccaagtcaaaaggtgaaaccgtgagtgtgtctttcaaatcacctgcttggccctcttccaaccgtgctttccttcctttcattcctgctccaaagctttttaataaactttcactcctgctctaaaacttgccttagtctctccttttgccttatagccctcagtcaaattctttcttctgaggaggcaagaattaaggttgctgcagatccgtatggattcactgcaggtaacaacaactgctgtgttctcccctccccagcacccagacatgctttttgcaccacatcgctgctgcagggggatgggagaggggttggcaattcagaactgttttttctgtctcttcagtgccgctttcagcaatatgaagttaaaaccagatactatgagggcttaccggatttttggttcttaggaaggtgttttttctttgtagatgcttgttaattttggtgctcctgttggggggatgatcagtggaagctttattccacagttttgctccaccctctgagtctcatattttgtgtagctcccgcacatttttgcacgttaatacatttgtatgtgttttctcctgttaatctcttcattgtcaatttatttcagcagacagttaatcaaatcttcatagggaaaatttaaacttccctatatattttctatgcaagtgaaaatataaggttgtaggtgagaacctgggttcaagagttaaaaccaaaaagcagaattcacataccattttcactgtgtgaacttgaatgttatttaacctcaatatcttcatctctaaaataatgtattaataacaagcttcagagtgctgtttgagggtaaaataacaagcaaactataaggcatatggtgattacacaataaatcatatgttactattatctacaaatgtttactatgacatattattatgaccaatttactattttaaaaaagactgaatatattaaattctatgtcatagttcaccttgttggaaaaccacagtcccagttcctttaactccaaagtatatttttcctccaagtgcaaatatagatatgatagtttttttttatttttaaatttcagcaatctgtatcaacaagctctggaaaggtgttaaaaacaaacagacaaaagcctaatgcttactctttgtccttgatagaacgtatgttaatagttaatgaaatccaagcagaatgtcctgcttcaaccttttcatcttcaaatccatctagtcctggctgtcatgcaccaacaggaaatatctaggaggcttctttgccacctgaatttgtttgttcgtctctttctcctttactaggcctgcattaacattttctttcttttatgaaaatattcaaatgcaaacagaaagcaaaacacttaatccactctagtaggtctgtgagacatatggcctgtggagtaatttaatccagcccaccatggaatctgaaaattgcttcttcaatcccctgctgtacccaaatctgaatgcaggaagaacagtctcagaaacaagagctcctgagtgctgtttctaaggggcaaggccacagaggtgtgcaactgtaggggtttatgaattcaatttactcatactcaaagcaatgcaagagaaataactgtagttctcctctcctttaaagaactctgggttagaatggaaagaattcaaagcttctaactcatttagagaaaatacagagccagatctgacccaggaccagaaggagaccttctaaaaattcaaatagctcccattgataactaatcccttgatgagacaaaactgacattatcaccttttcaataatgatggtgctttgtgcaaactacacccctccacacatacactgtaaaagctagtgatttctgctgttttgtgtacacactttaacagctgatgattttttagattttttagggaaaaaatactatataaacatgcctaaacctttttaaaaagggttttggatattcttctgtgagtacatgtgattaaaatacttaatgatgtctctgcaaaaacgaaagactctacattttaaggagttacatcccttataatagtctcattaatttgttcactcataatgctcactccaatttaatttttattatattattttatctttcttgggtttcttagtgggttttcattacccatagggctgcagcatgtccaagcacgaacctcacaatttcattaagttaattcagtggccaagaaatgtagttcttcataaaaaatgagacatctccgagaaacacaatttggtagagatattaaaatagttttttttaaattcagcaagtcatcatcattatatcctagaatatagcaaggcacgcagaagatggcatacaagcctccctaactgcatgcaattgctgaatttggaattagagaatcttctgcctcatcttggaactgtctcttcatgcagctgtccattcagttagtctatttacaaataatttttgaatatttttatatctgtaggtgctgtatgcaaatatgaaaagccaaagtcctcttatttgctgtctgaacctagccacgtcacttaaacaccctgagctccagttcttgcatttactaaatggggatactactacttcatagccttactgtgaggattaaataaaattatctatgtaaaagtgcctcatacatctaagatgttataaaaatattagttggtgatgatttccctgctcactgtatacagaacacagtgactatgacattattaccctctcttaatttttgatgaccaagaaggaccttctcactaagaaatgacccttaaccaacatctcttttttatgtaaaactacattaaactctgtacatccagtccattgcatttccttccattctcatccttggcaggggtcgggggaggaaattgttccatatcatggaaaatgttccacacctgcactctcccaagtcaaaaatttacttatataatttactttaatctcactttctaaggacttaatttagtggtaaaatgagaggctttctcagacaaatctgctggtgactattaccaagttctatgacatttttgtctcttcatccgtaaaataaataaaatatctacttaatgatgaattatgaaaattagaaatgaactgtgcataccttacctagctgatcaaagtcaacgtcaacagtgataaatcatgttcaaaatatgtacacttaatataatacggcaaaaatggcactttacaaccgtggtcttattccccaagccacctgtgtcatgatgagaaaaatatcagaaaaatcccaatgaaaggatgttctacagaatacctgactagtactactcaaaactgtcaaggctatcgaaaaacaaggaaagttgcaaaaactgttacagccaaaatattaaggagatatgacttttaaatataatatggtacatggaggagatcctgaaacaacaaaaaagggccacttaataaaaactaagtctaaataaataaaatatgaacttcagttaataataatacggttcattaattgtagcaaatgtaccatgctaatatgttaccaatagaagaaattaggtgtggcatatctcaaaactctctgtattatttttataatttttctgattgtgaatcagaaaaatttagaatcaccattctaaaaataaagttcattttaaaaagggatggcacatgcaaataactagaaatattgcctcagatataataagtgttcaaacaaatggtagatgttattaccactattatgtaattgactgtaaggcaattaacaccaaaattatgaagagttatttttaattaatatgcatatgttttaagaatgtcatgagagcaaaaaagaaatattgaaagaacagcatcaaacacatctattctgatatttcaattaataaactaatctgcttcaatcttcctgggtgcgatagttagttttatgtggcaatttgactgggctaaaggatcctcagctatctgatacaacattatatctgggtgtctgtgtgagggggtttctggatgagatcagaaattgaattaataagctgcatagagaagatttccctatctatgtgagtgggtatcatcaaatccactgaaggcccaaataaaacaaaaaagcagaacggcgaattcactccctctgcatgagctaaggcatccatcttctgctcttggatagcagagctcctggttcttaagctttcagaattacactgtgacctacacaccattggctcctggactctcaggcctttggtctcagaccaaattataccaccagcttttctagttccccagtggggcagatagcatgggacttcttggccttcatagcccatatcggcatgagccaatgctttttttctttctttcttcttcttttttttaatacaaggtcttgctctgtcacctaggctggagtgcagtcatgtaatcaaagctcaccacagtctcaaactcctgggctcaagcaatcctcccagttcagcctcctcagttcctggcactacaggtatacaccctcaaacccggctatttaaaacaaattatttgtagagatggggtctcactatgctgcccaggctggtattgaactcctggcctcaagtgattctcatgactaggcctgccaaagtgctgggacttcatgtgtgagtcactgcccccagccatgagccaattcttatggtaaatctcttctctctctctctctctctctctctctctctatatatatatatatatatatatatatatatatatatataaacacacacacacacacacacacacacacacacactgactaatatactgtgttaatgtagatagctaggtcagctatttttactactctcaaaccaaaatatacatttgcctaggtccagttaccatgatcttatttctgtaagcatgtagagtgagatttacatgtgttcgtagacataattaatagcctgaacaatctattgaatcttcttaaattttggtcctttcttcatcagaaggttataatagcatcaacctcataaacatgtgagaattaaatatagcaatctgtaaaggatctgaatagtgaggtttaaataaagaagtgttcaaaaattcctttcataattttttggcctggaaaatgcagacatatttaattttgtgtacatgtagctcacacacttataggtacacatatattttattttctacatttgaggaactcctcaaattttactttgtccaagaagtctcccttgattaacctgaaaagtcacagagatatttttcagcactatactagaaatagaaagtgtgaacattgacattaataggcttaatagacattagtgtttgcatacactatacacaaatatatttagccattcactgcacaagcatttcaagagaggcttctatgtgtcagaagctcccaggtgatgggaacacagagacaaatattctccatgtcctgccttaaaaggacctcaataatatgagtaaataaatatccaaacgcagatgttaagttcaaaaaactaaggtacatacacacaattgagtaatattcagcaacaaaaagaaatgaggaagatctctattatttaatacatagtgacatattgttaagtaaagaaaaagagcatagaggcttcaagatggcggactggaatcatttcactccagccttctccacttagaagaaccaaaatagtgtacagacagtcatactttgaatgcattatccacaagagaatgctggaattcaacaaagaagtgaaagaaaacatcaaaagtggggaaggagaagagagagaggcagtctgcctggctggcatcagctgggagccaggagtgacttccaaatatagggaaagggtaagccacagactttcaatgccccacatcctgactgtggaatcatgcaatcctggctatggagaaccctttgacctttgttcccctgtcccatggtctcctggaagctttcttggtcccaaaactaacatacgaagctgccagaagaccgtgagacagtattgctccagagaggaagctcatgttgggtcacacaccctttttgaggcctaagccactacagcaaggtgccattttcaaacctagcctttggcagactgcatgctgtcctggagcccagtgacactgggactgaggtgttacaaaaacttggactgtcactactagaattgggaagcaagtttggagtcctcctacagctgggattagagagcaagtgaggcatgaactgcagctaccagtgccaggaagtgagtaccaccggaatggagactggaatatgagcagaacatgagttgctgctgggacttggttgccagttgggtgaggctcctgcaactggggaggagcatgagctaggtgtgggctactgccagcatggttggggaataagacctgctgggacttgggcatgtgtgttcttcaactgccagcccaggctgtggccatcaaggacagccctgccctctccagtggcagggcctcagcatggctactactgcccttcaccagagcattatacttggggtctgaggattgccctacccctgtccatcatggctggtgcctgctctcatcactgaagggcctgagcacaagcttgcccagcccagcttcaacccccttctttgagacccatccaatagcctgagatccaggggattgaccaatccaccatcttgggcacctaagtattcatcccaggggtctgatgtggggcttgaattcccagccttgaccaactcagctctgaattatgtgcaagcacgaccagtgctcccaataattggtgggcccagtctatctcagcaactgctaaatcaatgcataccacctaagacccatagattcatcttgccactgctattgccatcactcataccatgccagcttcccagaggccaaagaatctgcccatccacccagttccactgctgccactactggcatccaagcatgccacctggaggcccaagagttaggccagtgataaccaccaaaacaggtaccagcatataccgctctgggcacaaagataagtatgttcagcccactgctgccaccactggggcctgaagacttgcccatctggcattccgatacctagcacaacttcaccataccctaactcactaagaaaatcacagacaccactaacactgcttacagtgaaagaaatcatacagagattacactactgaatgcacccagtatcaaagccaaattaccctacccaacaacatatatacgtcttcaagaaaaagtcctcacctgtaagagtatactcaaaaataggaaaaagtgactgttatacctggtgcacagataacaacataaggacacaggaaatatgaaaaagtaagaaaatatgacacctccaaaggaacataatgattcttcagcaatacatcttaatcataaagaaacttttgaaatcacaaataaagaattcaaaatactgatcttaaagaagctcagtgcagtacaagaaaattctgaaaaatgataaaaaagaaatcagaaaaccaattcagaatatgaatgagaaatttacaaaagagatagatagttcacaaaggaacaaaatacaaattctgaaattgaagacatcattaaaacaaatacaaaataattttgaaagcttcaagagacttgatgacgggtagagcaagatggcaaaatagaaacctaaaccatttgcctccacaccactgcaggaccaccaaatcttaacagctatctgtacacagaaaagtactgttacaagacctaaaaatcaggtgagcaatcacagtacctagttttaacttactgtcactgatagaggcattaaagagggtaggagagacagtcttaaatcaccaataccacccctaccccctgtcccagcagcagccattcggcatggagagatagtctgtaaacttggggaggggggagcaccgaaactgggggactttacattgaactcagtgttgcccattcacaacagagagcaaagctgtgctggtctcggccagcacctatacatggaaggaacacatggaccggatctagctagaaaggaattctccatcccagtggttggaatttgaatttcccagcaagctttgccaccatagacctaggtaaacttgaaaggcagtctaggacacaaggactgcaattcctaggcaactcctactgcagggctgggcacagtgccagtggacttagggttcatggaacctagggagattccaacttgggtggctaagacagtgcctgtgccacccctccccaacctcaagcagcacagcttgcagcaatgaaagtgacccttccttctgcttaaggagcggaaagcaaagagtaaagaggattttatctagcatcttggatatcaggccagccacagtaggatacggcagtgggcagagtcatgaggaccctactccaagcctgagctcccagacaacatttctaaatacatccttggccaaaagggaacatactaccttgacaggaaggaaccagtactggcaggattcatcacctgctgactgcagagcccttgggccctgaataaccagcagcaaaacataggtagtaccccacaggccatggtctctgagatgtgctggctccaggtgtgacatagcacattcttagctgtgatgtctagtgtaaaagactctgtctactgcactgagcttctttaagatcaatattttgaattctttatctgcaatttcaaaagtttctttatgattaaaatgtgttgctgagagagggaaaactaaaaacgactttgtcttgcaccttaggtaccagctaggccacagttaggtacagcaacaagcaggctcttggggtccccaagtccaggcctagactcttggacagcatttctggaccttccctggatgagaggggagcttacttccctggagggtgacttgcagacatggcagcatttaccataagctggctgaggagcccttgggctttatgtgaatgtcagtgatgtcctctcataaacccctgtgggctggtgatggtagtgaccaaagaagaaagaggctcttctgcctatggaaaggggagggaagagcagaaaggactttgtattgtagtttgagtgccgccttagccatcacagaatagaacatcaggtaaatttctaaggtttataaatctaatatctggctcctacacagcatctctggacctgcccagtgcctcagggaactcattgccctgaaggcaagaacatcatcctggctggcttcaacaccttctaattacagagccctagggccttgagtgaacatgggtggtagccaggtaatggttacagtgggcactgggcaagacccaatgctgtgccagcttcaggtatgactcagtacagtcctagtggtggtggcaacaaggatacttgcatcactacatccccagtttaaggcaggtcagcagagacagagagagagagagagagagagagagagagacagacagactgtattatttttggagaaagtatgggaagagaaaaagagtctctgcctgtaatccagagaattcttctagatcttattcaagaccaccaaggcagtgcctctataagtatgcaaaaacacagcattattgggactggaacccaaatccctctgaatagctgaaaagccatctgaagaaggatgggcataaggaaacccaaactgtgaagacaacaataaatacctaactcttcaatgcccagacaaaacaaacatctacaagcattaagaccatccaggaaaacatgaccttatcaaatgaactaaataaggcaccaagggccagtcacagagaaacagaaatatgtgaagtttcagatagaaaattcaaaatagctatgttgagagaactcaaagaaattcaaggtaacatagagaaggaattcagaattctatcagataaatttatcaaagagatagaaataattaaaagaatcaagcagaaattctagagttaaaaaacatgattgacatactgaagaatgcatcagtcccttaatcgcagatgtgatcaagcagaagaatgagtgagcttgaagacaggctactcaaaaataccgtcagagaagaaaaaaaaaaaacaaatttaaaaaaatgaagcacacctaaaggatttaggaagtagccataaaatggcatatctaagagttattgggcttaaagaggaggtagagaatgagttaaggcctagattctttattcaaaataataatatcagagaaggtcccagacctaaagaaagatagcaacattcaagtacacgaaagttatagaaaacaaaacagatttaaacccaaagaagactacctcaaggcatttaataatgaaactctaaaaggtcaaggataaagaaagcatcctaaaagcagcaaaggaaaagaaacaaataatatacaatagacctccaatatatacggcagcagacatttcagtggaagcgttatagtccaggagagagtgacatggcatatttaaagtgcttaaggaaaaaagaaaaaaaaaaaaaaacttaaccctagaagagtatgtctggtgaaaatatccttcaagcatgaaggagaaataaaaaccttcccagacaaccaaaaattgaggggtttcataaacaccagaccttttgtacaagaaatgctaaaggaagtagttcaatctgaaagaaaatgaagttaatgagcaagaagaaatcatcagaggggacaaaactcactggcaatagtaggcataccgaaaaacacagaatattataacacggtaattgtgctgtgtacactactcaatgtaaaaaactaaatgaggaaaatcaaaaataataactacaacaacttttcaagacacagttcagtaagacataaagagaaacaacaaaaaattaaaaagtggggggatgaagttaaagtgtagagtttttattagttttcttttggtgtgtttgtttgttcatgcaatcactgttaagttttcattagtttaacataatgttataaagtagtagttataagtttcatggtaacctcaaatctaaaaacatataatagacactcaaaaatgaaaggtaagaaattaagtcacaccaccagagaaaatcaccctcacttaaaagaagacagaaagaaaggaaataatgaagagaacaaacaaaataataggcaggagtaagtccctacttatggataataacatcaaatgtaagtggactaaattctctaatcaaaagacatagagtggcttaatggatgaaaaaacaatacccaatggtctgttggcaacaagatacacacttcacctataaaaatacttacagactgaaaataaagagatgaaaaaaatatttcatgtcaacggaaaccaaaaaagaacagaagttgctatattcatatcaaacaaaatagatttcaagactaaaagtatatgaagagacaaagaataaataattaaatgaaatgaaatgtaattatataatgaaaaagtgtcaatgcagcaagagtatttaacaattgtaaatacatatacaccacactggaacacccagatatataaagcaaacattactagagataaaaagagagacagacctcaataaaataatagctggagacttcaacctctcactttcaggattagacagataattcagatggaaaattaacaaagaaacaacagccttaatcagtactacggataaaatagacctaatagatatttacagaacatttcatccaacagccgcagaatacacattctcctcctcagcacatggatcattctcaaagatagaccatatgttaagacacaaaacaattattaaaacattaaaaaatgaaatattatcaagcattttctctggctgcaatggaattaaactgcaaattaataagaggaatattggaaactatacaaacacatcaaaattgaacaatattctcctgaagtaccagcaaatcattgaataaattaataaggaaatttattaataaaataaattaataaggaaatgggaaaattttcttgaaagaaatggtaatggaaacacaacatatcaaaacctatgagatagtgcaaaatcagtattaagagggaaacttatagctataagtgcctacctcaaaaaagaagaaaattttaaataaataacctaatgatgtatcttaaaaaactaggaaagcaagagcaaaccaatcccaaactgagtagaagaaataataaaagatcagctcagaaataagtgactgaaatgaagaaaacaagacaaaagatcaatgaagcaaaaagtcggtcttttgaaaagacaaaattgacaaacatttgcccagactaatgaggaaaaaaagggagatgacccaaataaataaactcagacatgaataaggagacattacaactgatactgcagaaattcaaaggatcattagtggctactatgagcaaatatatgtcaataaattggaaactctggaggaaatggataaattcttatacacatataacctgccaagattgaacttaaagaaatcgaagaccgaaacagacaaataacaagatcaaagctgttataaagtctctcagtatggaaaagcttgagactcaatagcttcactgctggattcgacaaaatatgtaaagaactaataccaaacctcctcaaactattctgaaaaatacaggaggagggaatacttccaaactcattctgtgaagctagcattactctaataccaaaaccagacaagacacataaaaaaatagaaatataggacaacatcactgatgaatattgatgtaaacatcctcaacaaaatcctagcaaataaaatgcaaaaacacattaaaaagatcactcatcatgaccaagtgggatttatcaaaatcatatgaaaatcaacgtgacacaccatatcaatagaatgaaggacacaaaccatatgattatttcaattgatgttaaaaaagcatttcataaagttcagcatcctttcatcataaaaatatccctcagaaactggtgtagaggagcatatctcaatataataaaagccatatatgacaaacctacagctagtatcatacagaatgatactagttctaagattgggatcatgaaaaggatgctcgcttttcatcactgttattcaacagagtactaaaagtcctggctagagcaatgagacaagagaaaaaaaattaaaggcaatccaagttggaaacaaagaaataaaattatcagtgtttgcagatgatatgatgttatatttggaaaagcctaaagactccaccaaaaaactattagaagtgataaacaaattcagcaaatttgcaggctacaaaatgaacatataaaaatcagtagcatttctgtatgtcaccagagaacaatctgaaaaacaaatttaaaaagtaatcccatttataatagctatgcataaaattaaatacctaggaattaagaagtaaaagatctctacaataaaatctgtaaaacacttatgaaataaattgaagaggaaaacaaaaaaaatgggaaaatatttcatgtccatggattggaaggatcaatattgttaaatgtttcatgttaaatgtccatactatccaaagcaatctacagattcaatgcaatccccatgaaaataccaatgatattctttatagaaatagaaaaaaaactaaaatgtatatgaaaccacaaaagacccacaatagccttatcctgagcaaaaataacaaaactagaggaatcacctaacttcaagttatactacagagacatagtaagtaaaacaacatggtactggcattaaaacaaacacataggccaatggaacagaatagataatccagaaacaaatccacatacctacagcaaactcatttctgacaaaggtgccaataacatacatcggggaaaagacagcctgttcaataaatcttgctgggaaaactggatatccacatgcagaagaatgaaactatacttttgtctctatccatagacaaaaatcgaatcaagatggataaggacttaaatctaagacgtcaaactatgaaactactataagaaaactttagggaaactctccagattacttgactgggcaaagatttcttgaggaatattttacaggtgtaggcaaccaaagcaaaaaaggacaaatgacactccaataacaatgagcacacttattgtttagatcttggattgtaatactatttcccactaaaatgatcctcagagaaatgactgctccccagggatggtgcagggaaactcctagatgaaagtgaacatcttttacaccagaaagtaaagaattgctaaaagtaacattggagcgtgtcataaggatacagaatttaggttgcaggggctcttactagccaaatctaggagaatggaagaacaaaacaaataaagatagtagtgtattacaacccactagagagaataatgagtcactaaaattggtatgagtctacactgataatatttattcaaatgaatgaatgaatgtataaacaaataaaggctgagggaaagttcttgctcataatagaatgtgaagtgaatacaaagggagtttcaataatcaaagtaattatcatccatctttaggcaataatcatcgatagatgccaagtctaggggcaaaattttgatgaagatcagaatattttcaaagtctactcaccaattatgtactacttgcaagggaaaaacatagtaaatgtaccacagcaaaaaatgacaatacgtgaattgagtgatcaaaattaatatcaacaatgaggggcaggtagacatcatgtacttaggaatgcaagaccccaaaagactcactgtcacctatatagcattccagatttggaatttataatctaaagaaacattagaccaatcctaaacaagaaacactctgtaaaatatatttttcagaggactatattctttaaaaatgtcatgttcataaaagacaacaaaaagctgagtaactactccagattaaagaagactaaagagacatggtaactcaaattaatacatgaacctagactgaatctttgtaatagaggaaaacatactgtataaacattactggaccgttgactaaactagaaatgtgcactgaattatttaaggtaaaggaccataatctatacaatttactctcaaatggctcagaaaaaaatataaatgcatgcacacagacatcgatatacttatatacgtatatacagatggatagatagatggcatgtggcaaacaaatggagcaaaatattaacaataggtgaatctgagcaaagggcatatgttttttctattaatcttgcagtttgaacttaaaacttacaaatataaaattaatgtaatttttgtagtgaagataaactatgtggatatggcatagcttagcaatcctgtaaccagggatggtgaaggaagttgggaaatgcctggagtgctaaggagaatctgaggagaaactgtgaagaatttgaatttatcctgagaacataggagatgtataagatgaggaaagtctgccttctcacttgtaaaagagacagaaaaaaaaatcaaatagagtgtttaatagaacagaaagaaaactaaagagactcattatttcccaaccagtgatacattgaaatgtaacatattaaaaagcatttttagcttagtggtggactgtgcagattgttgtgctgattctctaggctacttttctgcagaacagtaatctggtacattaaaataaaaactttagataaatttaacagagttacttcagcaaaaaaacaattcatgtattgggcagcactcagaatcagaagaggctcagagagctccgcatagcagcataagcagtaagcttttacatgctgactagcagaataaaaatagagaaatcaacagattgtctactgacaggcatttattttatttaggcatgatgtcatgaggcatttgtttactcggacatggttttatcagttggctgcttgtgattggctgaagctcagatgtttgtgattggttgaaatccaggtatttgttacaaaaaaatacattactaggtttccgtttgtttatggactaagttaggttgcagtttgttatgtaggagctcaaagttcagagacatcctgaggctaatttaacagcttatttgatgtaacagatgaaatgtgcctgggggaaaaagtgactgtcaagtgtgggaaacattacacagcagaaagtcttgtcttagagactcacaatgtataaaagtatattaaggctctaagaatttcagaagtggttaaaaaaaagataattttaaggccacgcatggtggctcatgtctgtaatcccagcactttgggaggccaaggcaggtggatcacgaggtcaggagatcgagaccatcctggctaacacggtgaaaccccgtctctactaaaaatacaaaataaaattagcccagtgtggtggcgggtgcctgtagtcccagctactcaggaggctgaagcgggagaatggcctgaacctggtaggtggagctggcagtgagcccagattgcgccactgcactccagcctgggcgagagagcaagactctgtctcaaacaaaaaaaaaaaagatgattttatttaatgcagtgttccttaaacatttaataagaatttagtttcctggtatcataggttgtattctctgaagtagaaattgagatgaagttttgggtaccaggaaaagtattgcccatcagagtgcctcagcttggcccaggttctttataccacattcccccctcagtcaccaagtgaggaagaccaggaagttggctctctgcagctgaggcccatcctgaaggagctgggagctggaagcagtctactgaccacagcaggctgactgcatttcctacagctgagcaaaacatgcttcctcaaagagggtgtgtctccatgttgttcacatttatctacactgctttccatcctgcagaatatactttaggaaatgatatcctaaacttttaagagcaagcaatttatctctcaaaccaaatattaattaaattgccagagatagaacagtgagatataagaccattgctctccatctgtgtctgtccctgatagtatattcctgataatagaatatattattaaagaactgtatttgcttgacatagtgtttacacagtatcaaagaaactctaaatgtttctttgtttacacagtatcaaagcactctaaaatgcagactttgttatcatcatcatcttcatcaaaatattaccgttaacataagtaatagaatagaaatacacagaaagatatagaagagttcagccttcgtgtatttaaacatgtattcactcaacaaatactcttgttttagtatctatggtgatcaggtatgttctgcgtatagtatttttggtactcataccacagatgggtgtgttattatagaaaaaatttcagaggcatcagcattcgaaggtttaataagatgtgtatgtaacttattgttgcgaggactgtgactccaggcacagtcacctattaattaaagctgactattagtattacaaatttctggcagagcacttagcaagggaaagagaattccctgttgttaaatatttaccatttgggtcctgtactctcatttctttcagggcacaaacagtagctcctttgaaaactgcttgacagccaattcaccaattctgcttcccctcgaagaaaataaaagccaaaaacacatggtatattctagaattgtactattgagacaataaaagtagactagaagaggaccctacttgatctcagtgggaaagtgttttcctcagtatctgtagcattatcagtagaaagaattgggaagcagatggcagagaaataaaagaaggcaatattattttttaaaaattagagctctgttaaaaacttcccagggctcttaaatatatgaatcatgtatttcactcatctaaaatgttctatctattctgatactgttatataacacagaataaattaataacatttttggtatatttcaagaccctcctattattatctcttgcagctgcagagagttgggtagatagagagaagggcagaatggaaagacagggaagaagggagaaagaaaataaattcagtgaattttatttcactgagtgtcaggagattttataaattattggggaaagatacttagacaaaatttaaactaaatgaattattaaataaacagatgccaagtggaaatgcataatttattgctgccacgcataagctagtttaaggatcccaaggctttttcttgtttgctcaactaaaatatttccacatacgaccttgtgtacaaccgaggaaaaagtgtagtacagtcatagtcaattaatcaatcacgtttcagtttagttcagcacatatttatacaatgtataaattttcttatgtgttttgaagggtacagaagtaattgaagacaccgagatttaaagaagaaaaatacttaagcatcaacatttgtttccagactcatccttcaccaaatattttagcatgtttgccttgcccagttaagagtattttggccacatttcccaactctaagtcctggaatgtttctgcccacttcttagccctgtaaacatttccttcaatacatgattccagggtgttttccccagctggtgaatagattcatttactgcatttcgtatatacacttcataaaaatgtattataaaacttatcatggaatgtggttgttattggtttaggtaaaagtgtcatccagtaaactgtgagttcctgggcctgagaaagatgtcttattctgctcaagaaatagaaagtgtgttagtattgaaatagtaaacactgtgagaattgaaaaggaaattataaggttgtaaatatatgcagaaaaatgtacagaacaatgattcttaaactttagtatctacccctctatgccttggttttcttatctctaaaaaatgtattaatgatataatttatataattataagaataaaatgagttaaaacaagaaattaagtcaaaaagtggtctggaactagttgaagagttaaaacttgaaagagaacagtactaacacatgggaagtgttcaaaaagtataacaataatataatagtggtgatggtggtgatgatgatgatggtgataatgatgatggtatctgtaaattctttaggaaagtggttaacaaattatttgagtgggtgaatattgacagaatttagtttagttttagcttctgttctgccatgagctagctgtataacttgggtaaaatagtacacttctaaatcttaggatttctatctgtaaaatgagaggtttggaaaatgcttttgctaaggtttcttcccaacttaatgtctttttttattgtataagcatatttcctgcattgaatgtagcccatttatttgtgattttaaggtagaatattgatcatcagagatttttttttttttttttttttttttttttttttttttttgagacggagtcttactctgtcgctcaggctggagtgcagtggtgcaatctcggctggctgcaacctccacctcctgggttcaagcgattctcctgcttcaacatcctcagtagctgggattaattacaggtgcgaaccaccacacccagctaacttgtatttttagtagagatggggtttcaccatgtttgtcaggctggtctcgaactcctgacctcgtgatccgcccgcctcggcctcccaaagtggatcatcacagatttttaagttgttattctttagagtggggctaggataaataatagagctgttacttaatatggaggccaatggtgtaacaaaacaggagggagcagtgagaagaatagcttacctagttgataagttttcctcccaccagcaggaaaaaaaataattatttgctaataatagcaaatgttagtacaactggcactgctagggcctgaactactactttgttaaataaaatgagattagcaaactgacctcaaaattttctttctgcaagttgtcaaataccccactataggagaaaatgtatttttctgttaaccaaattagagtaagagcaattccagatgattattatgatctctacaaaatcaataaattgctttatttcgtttcccactttttctttgtctctattcatccttgtctctttcggaggggggagtttagaggctgatttcagcagaatacatgcctgcattgtgagagctacatatctggcccactactgctccctcttctgacccagtttcctcccttccacaatagttgtgaactaccaattgccctctgtttcttttttttttttaattaaattcctatagctaatccattttcaagacctgaccattcttttttttttgatgtatcacaacatctcccccaacccccctcctatttttctactgtagccgttggctttcagttcaggtcactaatatatcacttacagttttctgcactggtcttagttcaattcagtttagtaagcattcagtgactacctactgtaaacaaacctgcatattggccaaaataagctaactgacaaatagcacaacataagcccactgtggtttctacctagggttcctcaatcattacattttgtctctaaggggaccgttagaaatattccattcaagcacattcaaatagggctttgtgaggtgatgaaaatactctgcatgtgtgactactgagcacttgaaatgtgtctaataccactgctgcactaaatttttaatttaattttaatgtaaatagctatactactggcaaatctaatatggattttatacctgaggaaacacacctaaaaggttaaagttactagtccaagatcacatggctataaaacttctcagtcatggtacactttctttttctttctatacacacaccgagagagagagagagagagagagagagagagagagagagagagagagagagaaatagtgagagaccgatgttgcagcttgagtctgaaggcaggctggaggcagaatggggacttgtctttttctgttaaggtttttgacagattggatgagggccactcacattatgaaggataatccactttacttgaagttgatgatttaaatgttaattttatctaaaaaataccttcaacaggacatctagtctagtgtttgatcaactatttgtgtaccataggttagccaagttgatacataatgttaaccatcccatgctccaaaattgaggactgtttggggatatattatctaaatgcaatgaagccatccatgctgctatgtcctaggatttcagtgattttctttgagtgtgtggctttataaatacgatattgtaatatttcacttgaaatttctattgcatagctagagaaaacatgacacctcacgaaagacacattgttatgaatatgggtattcaatgggtattcacttagtctgcaatgattgtttcttttcaaaaagttgcattatctggcttttgtttgcatgacctaatatcaccctctaattaagtcagaatgacatattaaaagagattgaagtaaataaattatatttgtgaatatgactataataggtgtatgatttgccctcccatcttcctcctgcccctataagaaaacaagacacaggaaagagaacatccccacctatgtttcagatcatccccattctttttctaactccatccctcttcatcaccaaaacaattttcaaacacaataaacagcatgtgtcttaagcaaagcaaagtagaaacacgttaggatttcttggagtttccattttacagtattaatctttttatgtaaacttttagcatctctgtatttacagcactaccaggtaaaatataaatgcatctggctcttcctatgcatcggagtaccctatgtccagttttcatatgtcaagtatcagcacctgcactaaataaataataaaacgaattcagagactcaatatttatgataatccaaacacgctcaaattattttgaactccttaaagccagtataacagcttctattcagatgcaaaaaataccaaaaaatgaagggaggttttttactgtcaaaaataattattctttttaataatatgttttgagcaatgactacattaggaatcaccatacaaaacactcaaaaagtgagaatataaagtttcagtctatgccatcatggagattttagtcaagaaaaccacctttaacaaggaaaataaggacagttgaggaggatcttcaatgtcctagaagtggaactaatcttgcatggaactaattcttttcaccatgagcacttgtggctcagagaataaaggtaagaaaatctagtcaggtttcataactgctttattccaagctagatgcttggctcagatcacccccattgtgtttgaacatttggcctccccaataaaatacacataccacgaatcttcctcctgtagaattaaattgtcagcatgtcacaagatttttttttcttctgcagcaggaacccttctggttgaaatagcatatttcctgtacagcagggtttgcatgatatcattacttcgcatgcagtctgcatgccttccactggatgtttagtgtctgtgaatgttctccttccagagacttgcctatatttgtcttcattctgcttgcctgggttttagcctactcttaccctagtgtttgatattttggacatggtggcctacatctgtcagctttgcttcagctcactgcccctttcaaaactatgacaacttcttaatggtcttcctgacaacctacgaaatctagactaacaaatctggccctatctacctgttgtcctgcactgttgcttgcaaggctcttctgatacattacagtactgacccagtgggtctggtttgctaataacttactgtaaaactacagttaaattgtttttctctcacctagacatttttataggttattattaaaatgcatagataagctgctggagtataagaaaaaaaggaatcaaagatgtataattctagatttatatataataggagagaaaaaagaaatacatcgttttattatcttggatatattctatgtgccacttagtgattgagcaaaagataacatgattcctgactcttagcaactcatgacttacaggggatggtatgacttacatacaaatttggaaatattattatttttatagaatatatttatagaatttttttggattatttttatagaataccaaagttatttttgtagaatattgaatttttatttttatagaatattgaagttaatttatcataactacctttactgtgggaactcagactttatttggtaaaatcccgctattctgatcttttgaaagctatcaattaaagtaagtaataattattttatttttatttcatgtatataataaattctatgggatagagagaacatgctatattttcttttcctagaatatcataaatttttgccttcagtaacaagggtaagggagctaacaataagaacttactaagaatgagttattctactatgctctttacacatattagcacatttaatcctaataggaatctgataatcatgttttaataaattttacatagtggcgaaaatgtgactcaatagaactgaacaaatttctaaaaataaaatagctagtagatggaacacagtcaaaatttgaaggcatgtctatttgacttccaaatccatactccataaattgcaccctgagaaaaacatctttctagaaccaaacaataggaacttaaaatcccaggtaattcctacagttgtcctccacaaatgtaataaaattttatcaagtgttttttcatagtactctattttacttactgcagtatccccacatggggatacgctggtttttacatttccttcattttctgtaaatgttccagtgagtagacataagaagcaagtctgcttaggctgttactgtgtccctactgattaatccctagaactcactgcccctagaacacagatacttaatatacatttattgaatgaataaaaatgactgtaaagggggataaatctttttaaataactcatatgccttggtttaatagaaatctaataattatcatttaatcatttgaattatagataattctattctcatatattgattctatttcttttctataaatgagtaatatacttaaaaacagattaattcagtgatgtctggttttattattctgaattttatattttagcatgtttaccataagatatgactgggagaatttagttttactccctgggtttaatatctggtttcagtaatattatagtagaaaaaaatctgttgtgtactactattaagtgttgttgagcactaggagatctctattttactgtgtctttgatattaacatccgtatttcttgatggtactgagcttagtagttaacatttctccaaccttaataattgtgtatggcatattgacagggaaccaaaaagcttgcatgaatttgaactgtcatctttttttcttactaatttccaagttgggacataattttttatttcattatcactctgtgtgtttctttctttatatactgtactttgtttctccattttacttcctttaatagtctaacagttggatagaaaagaatgtcacttttatttattctcttttttctttttcactgaaggcaaggaaattagctccttgatggaaggcacactagtagaacacatcagcattatagaacccttgaaccttaaagacatcttatctcagcatattattattacaaaacttaaaggagccatcgcaatcttccatttgtttaagtttccacttcaactaccatggtcacacaaaatgatggtaataagaatgcgattgttgaaaaccaaaccaaacctcatcaacattgttatcagcctcactgagaaacaaggatcaaatttacatctacctgtgtctccttggatagtctaacaattttactttgccatttgctatcaaagaagctgtaggatattgaatatagaaaatacaagtctgcaatgcttgagtgaaatttcaatcactgcagacgtaaaagttttgcaatatcgttttgtaagaatgaaaataaatatagatatatatgtacataaacaaggtctcactgtcttgcccaggctggagtgcagtggtgcgatcacagctcactgcagcctcaacctcctgggcccaagcaatcctctcacctcagcctcctaagtagctgggactacaggtatgcatcaccctgcccagctaactttttaatctttgtagagatgggatctcactatgttgcccaggctggtctcaaatttctgagctcaggcaatccatccacgttagcctcccaaaaggttgggattacagctgtgagccaccaagtccagctggataattctaccacattatttgtcttgcctcagaaaatgttatttgacagaatttttatttttaaaagatttatcaccatcttccttatcaatatataagtagttggctcactctgtttaaaaaatagcacaatagatgacatctagaatataactttaaaaaaactaccatttgatagcacctagaaaatctcacacttcttgcagatcaaaaaaaattatgtttctatcatatttaaaatattttttcaaacctcaattaataaatatctttggtatgagtcatatattatagtttactgaggtcagaaacaaaaactattttaatggaattctgaaattaaccacaaaacagttttgttataattgagtgtagggctcccacatctctgtgggataaaagtggctatctatattttaatccctttacatcctcaaaaagtactacaaaatcacaatgagagaaaaaattcagcaaacacccattcctagccaagtctaggaggcattatgactgcatgaataccttaagccaacagagctggatccagagcccacactagcagagagaactggggaattttgcactggaagtagtgtacagcagagtcaaggtactggcccatcaaaggcaacaccgtataggtatcatacctggaaggaataaagtctactttgagtgggaaaatactgaaaagagccctgagacttggtggtttagtccactgtcactagggctaaaagtaaggagcttagtggcagtcttagaaaggcagtatcctgagggcagatggaggcaactttgaaaacgtaggtgttccctacaggcttattggcaaagcgaaaaaaatatgtgactaaagacataaagacgctgaaaaaggttagtatcaaaaattagaaaaaagcaagaagtacacatttatttttaaagcatattttgttgtggctcagaagagggtgctaagcaccaaaaggaccatccaaaatccttatgccaccctcactgaattatcaattatcatctgtctaaaaaaatacaagtacatataaataaaaaggaatccagtatctatagaagttcattaagaagaaaacagaaaacagagtaaaacattttcagaagattaaaacactaaaaagtagtgatgaaacaggcaggtattattataatatattccaagaagaattaaacatgaagcaagcaattgtaaacatgagggaccatcacaaacttagaacttaaaaactcagaataatactggataaacactacatggatatgaaatcagagcagaccaaactcaaaaaagaaactacagaataataacataatttcagaaagaagaaataaactacaaggtccaaaagagactagatatgtccaaaactacaataagaaatatatgactaaaagtacattaagcaatcagaaagaaatggataaaaaagacaagaagatctatttgataagtggagtccctaaagaagaaaaactaaacaactgggatgtttgatataaaaaccacaacttaagaaaactttactgaataaactggaacctcatattaaatgctgccatcaattatgtgggaaaaatcaatccattaccatcaaatattagacatatcttagtaaactattataattttaaaaaaccctttgagccacagtcaaatatgaagtaattaacaagcaaaaaaaaaaaatgtttacatctaacttttcaacagcaacataccagtgcaggaaacagcagaagaatattatgaaatgcaaagaaagaaagagggaaagaattaatatacagctgaactgtgtatcaagtgtataaaagcacagttttaatatgaaaatttcaagaaactttttactcaggagcttttcctgtaagatatactagagagaaagcttcattcaaccaagacagagaaacggcagcaaaactgctggtggtgaatgcaatgattatttaataataaatataattttaacataaaggtgagaataaatgtataagaatactatgtaaatgataatatggacattttttaatggaagaagaaaaaaaagaaaatgaaaaattggttaagctccttgatggccagataggtgctagtcaagggatatcacttaaaaatgtaaaactgttaccattttactatataatactgtattttataaaaccacccaaacctcagaggcttaaagcaagaatcatattctcgtggactgggctaaatcctatgaggcaatgctactaatctaagattgtctcattctcatatctgggtgttggctagggaaggctaaataaggtgaggctcagctgaggcagtttggctttgctacacaagtctcccatcctcaacttgggactttttggctcaggcagtgtcatgacaagccaggcctgtttgtcttatggcagtgggagaagtacagtagagcccatggaaacacacacaaagtctctgaactctgacttaaaaatgccatactaatgtttcaatctcattctattgctcaaatagggtcatattgtcaaactaaacgtcacaaggcatggaaaaatgcaaatatgcctaaacatagtgtgaaattactacaaaattacatggcaaaaaatttgaatacaggaacagttggataatcagaactaataacaaactacctacaaagagaaaaaaggctaaggagaggaaaaagagactatgttctatgaaagttaccactagaacaaaaccacaatatttatgaataccaaaatatatataaaataaaaatgtaaaaagaaaaagaaaagaggtcacatagtgaaacgtagtgaatataatatatttagtaattttaacttaaaataacatgagctgatgccaggtaaggttgtgtgcacctgtagtcccagctactcagaaggcttaggcgagaggattgcttgagcccaagagttcaagaccagcttaggcaacatagtgagaccctgtgccaaaacaataataataatatgtactgagcccaaatatatcagtcacattaacaaatataaataggcttagatgacctattaaaatattttcaaattggcttatcagtaaaatccccaaaacctctatgttgcatataagcaacaaaactaaggaaaaaggtacaaaaagcaaaattaaaaagaagagcaaaggaatatggggaaaaattcaagaaaattatgcagaagttgcaatgttgctacctgacaatgttaacaatcaggcaagatgctttacgcaagacaaaagaacaatgctccataacactacatctacaatttacaagaaagacagtgcaaccatgaatagctatgtaccaatcaatacagcagcaaacttcataaggaaaacactgatggttacacaaaaaagaaaaattgtagaaacttactaataataggagactttggcacagaatctcgttctggacagatcgattagacaaaaaaatatagcatatgcaaaacacaaacagtttaatcaatgaagtgtaatatacaagtacatatcaaattttgcaatctagaacatattctaaaaataaaaagcatacaaagaagttgtaagcttctcttgatgtccacaagctaagcaaaaacaactccagtgaaacaagcctagatttgttttttggtatagcacaggagtctgcatcccagaataaactataggatgtctcaagaagatgtaaggaatggcttgtcataaggtttagctctatgctagataatctgaggaagagttcaaagaacaagagtttcctcaggattgaacactatcataaagcaggggcaattcagtgattggatagtttaatttttatttaggagtcaggagaaactaaatggagcttaattataattggtaaaaataagcagtcactcatgtgagataagagagggagacagtggatcatttttataatttgcactgttctgttttgttcgtttgtgttttgttttttagtgttccaacatgagtgtgtcttcatcctattttatcctgtttcattatggtcgcagaattactataatcgatgtcggtgttctatgaagttctgacaaatccaccatttagggtattctatgagaccttgatttcttcaaatagtcaacgtggagattttaaagacacaatcctaaattctttggtactcatctcctcaagtggaacttaattctctacccttctggctgtgggatgtgcttagtgactcagttctaatgaatagaatataacagaagtcatgggatgtcatttttgagattaagttatgaaaagaccacaactttcattacagtctcaggctctatctctgcccccctccctctgtctctgatcgtttgccctggaggagccagctgccacgttttgggaaaccctatgaagagctccatgtagtttacaacagaggactcctgtgaagtcagcatgctactaacaaccatgtgagtgaactcagaagagtagccttctgccccagtggtgtcaccagataaatacggtcctggtggacatctagactgaaaccttgtgagaggccctgagccagaatcacccagcgaagatgatcccgacttcctgacccactgaaactatgatgtaataatgtgtgttgtattaagccattaagtttgagggtactttgttacacaacaatagaaaactaatacagttaacgttatagaaagtaaaaagtttaggttgactgggactaaagaaatataataatatagcaatagctaacacagactagagaaatgtaaaaagcaattacaaaacgtaacttgttggcatagatacattttgaatatgcaatggaaaagagatgatattaagaactatttctcaattgtaatattgtttttgtagttatatattagaatgtgcatgttttttaatgcaagctgaagcattcaggaactaagtaccgtgaagtttctgcaactagctttcagatggttctgccataaaaattgtatacatgtacacagagtaaatatggcaatatttttaaaattacttaagctatgttaatgagtaaatgagggttcattcttttatgcctgagaaattcaaacatttctctaggtttaaattttttcataataaacaggtggaggaaaattacataaacgtatcctggaaaaaaagttgacaaaatgaaaaaaagtcttacagcttgtcaaatcctttcacctagtaattcctttccttgaaatgtaacctaagaaaacaatgagatgtggcataggtttgtatatcagaaaatttttttcagtgctgttatcattgcaaaaatttggaaacaatgtaaattcccaaagtagagagtgagtaaagaaatcatgatgtagtcatgatggtatattttattgtgattaaaaataatgttttaaacatgtctaataacctacacagggaattgttcaacattaatattgaatggaaaaggaaagataaatatgcaggaagattttaaagttatacaatattatataaattatatatgaatgtttgatttttatctgcttctgaaaggaaatacaccacaaaatgttaatatctatggttaataggatcatactcggtatacatggatctttgtgtttttcaactttttttctaaaaggagtacagattactttgataatcagaaaatattggtaattaaactttaaccatatttatataattatattaaaattttaacataacgtgtgttgtaaagacttttattctttataatgaaaacactttgaggaagacttatgctatagcaaccaggtatattgtgaacagctaaaatacaaatccacccttttacttttttcttttttgtatagcacttagcataccacaattcagtatttattggcgttgaaaatttaatttcattttcattggagtgacttttctgttttgtattgccatcgtacagctaaatttgtaagtggtactttcaccctttgtaactggctttagctcctccttgcttcattcaggaggaacctgctacctttgcatggttcctcagtctaagacgttacagctaaaatcccctaaatacttcagtctattgcctgtcatataaatgggagttttgaacatattttaggcaaaaatttatgtttcttgttcacttttttgccttgctatgatggatcaaatgtatttaacatgaactttgagtgacttttgtaaacccgtttacttaatctcttatcggttctctgtgtttgaacaaaatgcttcaggatgatagaagcagcctaacttattaaatcgccaaaatcactggtctagttcaagtacaccttgcttgattacagatgttcaagtcagtctcttgtcctctagggcaaaagaaaaagaaaatgtatttatgagctgtagtgaattggtacaaaagttggatccagatggattgaagtcagctcctacttgtaagttctcaattcttcagaatatatttgagaaaatctatttaatgtgttgaacaaatatatgttgacattttagcagcaaaaggttgttgacctgtttttccttccatcactgttatagcatttcgcactttcctgtgtatccatctctgtgttgcatgttgcaggtacaaagatgactaagacatagttctggccttcaaggagtcatgtactaatgaggaatatggacacatagacctatattggtgatttcataagtactatgaaaagagatatatgcacaggatatatgagaaaagagaggggcaaataaaatttaaacctaggggttcacatatattttagaactataaacatagcctttttaagattatattttatgctcatcttcaataacaataggaccagatttattcatctagacacggttatgcattgaattccattttaactgcaataacattattttcaaaaccatcactactaacaaactaggttcaaaaatgtgggaagtgaagtctgcattagtaaaagtttggaaaaggtttaatttccattaacataattacgattgaactcttctgcttctcgctgcctacttttttatttatggcagattttgtatatgcatttcaaaccaaacaattttctctttttttgggcttttgattctttcattacttcagtctgcagctggcacttacttaaacttttattgagaatttgcaatgatttggggaatggcacaggcaatacttccaccagactcgggcaacacattatgtactaactttttcccgtgaaaaagtaaatcatttggctctgataattatattgcatttaaaatcctaaggacaattttgcatgttaaaaaatcacattgaatttctaaattattctgatttagtaatgatagttatagaataacaacatagtaagtcatatgttgacatatgtttgaaactgctattgaattttcctagtttaggaagcacacatgcctctacagatagaggtgatgatcagcaattctttgaagatggcagtgatatttttatacgaatcttttatttgttattaaattactaatccaaccaatgtgggattggcaggttttgccagatttttgacacgtttctctttttggagttagatttagatgctctatttgctatttcaagctgttccattttcatgatttcactatagtaatgtagttctatacattccaagtgtcttacccttgttatgtttccttctatagtgatccaaactccagcatctcatgctaattaatatacttttgcaacttcaactataatgtctttattccttttggagcataattatcacttctgacccactacctatgagaacctagaatattcaacacaataacaaggtacttagaaaatttttctttaattgtgactttatgacaaagagaaatatttgacatatttattatgtctttaaataataaaatatatgaaatcacttggcacataatggttactaagacatattagtctcttccatccttaattataaaagaaattaagagtcagtggccttcaaagtggagtatgaatgcctttaggggaagtgaaaagagttaccactgggttagaaaaaaatcacaatttcacatgctactttgtattattacattatattaagttgtctattttatatgtcttatattacaattatatagatagatacagatttataatactttgattttcgtcattggcacatgctcaaaaagtttggaattcattggattaaatgaggttgctcaaatttcagtcctcacatactattttggaagttttgctgtatttgactattgccaaagataattttaatgtactgctaaaaaggacacagttaaggcttgaaaattcagaaagtgaaagcccatattagacagaagatatacaggaatgtgataaatatatgattgatgatagattagatagatgatagatagatagatagatagatagatagatagatagatagatagacagacagacagacagacagacaaatagagctagataaccatcattctcagaagactttaggctgaacttaacaaatgcttgaaacgttcgtggtcatctccagtcccacaccagtaattcatgtgttctatgtaactggatggcaatgcccccatcttactttttactttgtcctaaaaaataatatagctgcatacaacattatagtatgctaacaacgtctgtgtaatacatataaatacataattattaaaaatacaataaataaattgcaacaataccacttaaaatatcatcctcactcatgtcagtccagatatcccattacactctctgggtaattagcacaaaatgaccatttggcttgatgatcagaaaggcaggtggttgtacaatgaacatgagatgcttcagacagatctctcacttaactctgtcatatagtagctctaagcctgagcaactcatactgtctgaacctcagatttttctgcagtgtgaggatgacagtatcctgagggagagtcgtgagaatttgacactatgttggggactatctcaatgttcagcgcatggtaagcactcaataaattagagctactagcctttgtaactattagtgtccttgtgtttgtagttccatttggtcagaggaactttcagttaatattgatgccatgagtccagcctttgttagccttcatacgctgtcctatctttgctctgtgttggaagctcggatttatgactgtgacaaaccaggaaattaatttcagatccaattttgcaatctccagtattcctttctacaggtatctaaatgttgattttctacattgaggttcatacaccacatatgaggaaatgatctggtatctatctccaaaactgtcgctagatctcagtgctcacagctaatattaagagtcctcacagactcatttctccaagtttctgaattccttgaacttcatctaaggtggatgcacacataagcctttctcattctcctttcaaaatgaaatttcctttcagccttcttccctgcccaaagcaggaaacaactctcctgctccccagcagctctctctatgttttcacaatattaggaggcactgtctgctatttggaatcattttggcttattataagggctcacactgtacttcattagcagggctgctgtgaaattatgaaacattttggtgaaaattacaagctatttagactcatttcttgctgaaaatatgcaaagcccttcggggaaaatgcagacagatggtgtttgagacatttattgtttttcctatgtatttgtaaacaaatactataaattaagcatttcagaatgatctttagaaaatctagttgcatattaatatatcaattgatatcaaattaaagaaattgtgatacccgtttccatcttaccagtgcattttttcctgtctgtactctgttttgaaaaggtttcagaattgatccaaaattgattgttgaaaagctccagaaaaagcaaaagcaggagtctctgttctttttttctccaggtatattttttataactcatgtaagtgcaataattaaccctacaaaaatattatatttttcctcatatataacaatattatttgtatctacctagaaaaccttatgtagcacaaattcacagtcatctacaaatgaaatgaattattcacttcttatcatttgagagtctacaaaatgtaatttatattctttgtgggttatctctagggaagagctgtgatgtttggaagcttacatgtgctactctgaagactactggagcaagtggtagcacatgagtaactgtgtttaaaggaaagtgtccttagtttctagctattttagtgctaaggcaaaaaattattactagtggtaataagcaaagttcaaacatggttctcatgcaaatcaaggaggtaggtatttttgaaagtataaatcatccgtatctctccattagttgatttaaattttttcttttattttgcttaatgttccttccccttgttccaataataattttactccagtttctatttttcattttccagtgttgcctacagaaaagcagagaaaaagtccaaataatgtatttgatcaccagaaaaatgtttctaagaaatatgtaatagaaataaaataccttttagagcacacctttgtagatatgttatcaataagcaatgctatttttgtgtaagacatttactgtattttgacatacagattaattttctctggttgaagatgtgcataaatacagagaaaatcttctattttagtgaaaaagattaagccaatgaatcatagtttttctgacttttacaaataggcatagtcatttctcccaatagtctcataagaactggagttagaaattgaattgcctgttctttttctttctcactctcctttactgcatttcccttattctctcattgttataggcagattaatatatagacacattttagaaatttctaaggatttatgaaggggtatattgaatatgaagataatcctgtcatggacaatagctaggtatcatccctcttaaaatgatgtcacatggaggatgagctatgacaagaccagctccacattcctcacagactgtccatacagatagtttacaaaaaatcattcatatcaagtacttggcattccaatgtgagaaagaaatagttatttctatttgaacaactctccatctagtgggtaggtaattactgtgtaggtcgttattcacagtttcaattacaaaaataaagttaaataaaataagtttaagaaacataataacgggcttcatctaggatgaccataatcctttcatttgtttgtattgtttttgaatttgagtgaattaatttattcaaaagcatgctttggatgaaaatttcttaacttgcacaagagctcctaactgccttaatccccagtctacacttttctcttttgtccataagtaaccaatacaatgtttttaagacatcctccacaaatcatgattcatcatgccactggatcgagcaggatgaataatctttctctaggtccagaagatctagactataattcactttcctctgttcttcacaaagaacataaaagcacttggagatatcaccacaaccatcatccttctttgcctctcatatacagaaaagaattataagcagattaaacatgttttgtagaaaacagttcctctattacttctctccctttttgttcctttccctgaagcaaacacagctgtttaaagttcaaccctgttaagtagaatgacagaagggatttccagacaggatccaaaatgggctgaaaattaaaacttgatatcttcagaggatagatttgttaagaaagcctagaagtgatgcatgatatgattacctataatacctgcagaccaaaaagtgacatatttgctctcagtggatgtgtctctaaaaacatggcatcctaatcgtgtacacttaatggagtatgccagctcagattgcgagattcagaagcctagaagcaccccagtactttcagttggtgaatttgtcacctgacaatgaaaatcctacttctaaaagtaaaattataaccatgaggtgaaagacctctggaaggaaaactaaaatattctgatgaaagaaactgaagagaacacaaacgaatggaaccatatcccatgtgcttggagaggaagaattaatattgttaaaatgaccatattgcccaaagcaataagcagattcagtgtgatccttatcaaaaccaatgtcagtttcacagacatagaaaaaggaatcctaaaatttatatagaaccaaaaaagattccagatagccaaagtaatactgagcaaagagagcaaaactagatacatcatgctacctgacttcaaaatatattacaagactatagtaacaaaaacagcatagtagtgatataaaaacagacacatagattaatggaacacaatagagaacccagaaataaactcacaaatttacagacaactgatttttgaaaaaggcactaagaacatatattagggaaaggacagtctcttcaacaaatggtgcttggaaaagtggatattcatatgcagaagagtgaaattggacccctatctttcactataatacaaaaaacaacccaagatgaattaaagacttaaatgtaagactcaaaactataaaactactagaagaaaacataggagaacacttcaggtcaccagtccaggcaaagattttatggctgaggcctcaaaagcataggtaacaaaaacaaatgcagataggactatattaaactaaaaaggcctgcacagcaaaggaaacaatcaacaatcaacaaagaaatgaagcaaagtaatctattaaaaagtaggcaaaggacgtgaatagacatttctcaaaataacatatactaatggccaagaggtatatgaaaaagtgcgtagcatcactcatcaccaagaaatacaaatcaaaaccacaatgatatatcatctcagtccagtaggaatggctattattaaaaaaaagatcaaaaataacagatgctggtgagaatgtggagaaaagggaactctgaaacactgttagtaggaatgtaaattagtgcaactattatgaaaaacagtatggatatttctcaaaaaaattaaaaatagaactacaatatgatccagcaatcccactactgggtatttatccaaaggaaaagaaatccgtatttcaaaggggtacctgcactcacatgtttattgcagcactattcacaatagcaactatatggcatcaacctaagtgtccatcagtggatgaatgaagaaaaaatgtggtatatttccacaatggaatagtatttggtcacaaaaagaaatgatatcatgtaatttgcagtaatatggatggaaccggaggttattatgttaagtgaaataagtcaggcacagaaagacaaatatctcatattctcaatcatatgtgggagctaaaaaagttaatctcatgtaagtaaaagtagaataataaatatcgaaggccaggaaggatgtatgtcagggcgagggaaagaaaagaggttggttactgcgtacaaatatatagttagattcaggaataagatataatgtttaatagcagagaaaggtgactattgttaacaacaatgtattgtgtatttcaaaagagctaaaagaaagaactggaaatgttcccaacatatagaaatgatagatgcttgaggtaatgaataccccaaataccttgacttacattacacgttatatgcatgtatcaaaatatcataggtgccctataaatatgtacaaatagtatgtgtaaactaacaaaataaaattttactgtacaaatatatttgtgaacaaataacaaacaatctctgaagacgaatgacacctccagcttcaaagaattgagctgaactaaactgtgctaaaagaaaaagaactgagcaactgtggcaggagacagctcttcctattgtatgaaatgattcacggtggactcggggccaacaagggtgcatcagatcacatccaggcatcttgatgtctttaggagatccaaatttagccttcagattctaggattttactgaaatagaatacaacttctcattcccaaaatataatgaacgggtgtgggtgggggaagagggggtggaggattttagaaccatgaatataggagggaagaagcttaaaaataatcttgaatatctcccttattttatagatagtgaaaaatagacctccaatcaataggtgatatgagctgggctacatcattagtcagggctaattagaatctagttcattcatttgaggttttaaagaatgcatttatgtatctgtgtattctttttccacgtatttttatgcttcaacaacaaatttgagctctgtgaatagattgcctgggtttgaaacactgactctggcacttagctaagtgattttatggaatttacttaacctttagttcccctttcttcatctgtaatataggcacattacaatatctacattctggggatgtagtgtaggttaaataagttaattcatacaaagagtttaggacaatgcctggcatataagatgtgttcaatgtgtgttagccattgtgattagcccttcatgtcaccttttgtagattaaaaaaattcaaattaacatctcaagctttcaattctctttcaagatttatctgaaaatttcctcatttacgttgagaaggtcttcctagttcaaaacctagtacctcaaattaccatgtcccaaatttcagaataatgaataatttcatttttctgcaccatgtcattccccttttgtgtttgctgtcccatcgcaccattcttttgtgttacactattccccaggtgtagagaaacagtctatgtcagtacaggcttaaaaagaaaactctcctaaatgggacttttttttcccaggattgtcttaatttcatttttaagaaagttaaaaacctaatacataaaaataattattagtatattctacatttcaataatattttaaaattcaatctataagcaggacaggacagatgaaatattgaatcttagggcaagaaaggaaaagccagacattactttcattttgcttttttgccttctcctctgctctgtatttctgctttatgccattcagttatggatgttatagtaaacatctttgtttctgtaaataaatactcataaatctatatatgtatgtgtattcatctataaaaggaagaataattttatttaccaagaaatctccccaagaatttttagcaatagcaatattcagaatgaaaaaaaaaaaatagcacgcttcctagtacaggtgctgtgaagttgctgggcacccaaccatcaccatccaatctgcatgacttgtgaggggttgcagatatcctggaaaccacctcatccaggaggcacataagaaattggaggaagccaaaagaagtgagaagaaagacagatttttttgtaatggttgcactatgaaatataaaaacctgttatatctttgaagaacccaattttatgccctgcaaaacacctggactagccactttaagaatacctataacaatattagcatgctttagggtttaagtgagatttctgatttcttcaaaagtaactctatgaaaaaaaaaactgaattatatgtatcatacacatagagaatgtgtaagaaggtaaccctttagagatatcttattgtctactcttttgggttgagatgaaaccatcctaactagtaactgacacgcctgtaaataatgtttacaaaaatccatagtctagacataagtatctgagcacatatatgaaaatataagctatctgacatacacgtctcatagttctgaatctgatatactctaaccagacctaaccttcaaaatcagtgccagtgactataaggagagatatgtttaccagatgctacaggtaagcttcaaaattatactgctattgaatgtcaagtggatgaagcacggtcagcaaaatgactaacattaacctgattcccatttccgtttttcttttcaacttttgcaatctcggagaacctgctaatggatcagtttcttattttgctgagactgtccattataaataatatttctatgcttattatcaataatgccactgctgcaaagcaaattcaggccagttacaatgcacggtacaaagctatctaaaatataagtgtgggtgtttcagcttgggtcttatctcatttgaaattgaaatatgtttgcaatgcttgaatgtgggaagattaattatcacctctgtttcaaaataagcagcagtagaaacccatcacatgaaaatgtggaagtgacattgtcgacagctaacaagagaggttttcagctggaaaagggtgcaaacagaaacaaatgcattcatatttctaatccgcagccaagaaaaattgtatttgatactggctgaatttgcctcagaaaatcaaagccccattttggctaggatactaaatgcagcaagatgaaccacagaattctgcctcgcagttacatcaatgctttcatgtttccaaggtcaggctagctctggctttttttttttttctcagtaagagagaaaagcataaacagtcccgccattgacacgcaatgtggccttaggcaaagaagttaatctctctaaacttcagtttccccatctatgaaatggacaaaataagcacatgcttagctcatggaatggatgcaagtctgttatgtattagtataaacaacacgcgtctagcatgcagtaagagctcagcagtagttagctattgctgttgcaaaaccatgccattctgttctaaaaccactaaaacaaaaactcgtccttcctgtctgaatgcagctctatctcaagtagtgagggtaatagaaggttcagttccccccacttcttaaacttcagtgattaagagagatcattttgatgcttcattcctgaaagatacttctttttttattgttgttttaaatgccatgtcagaacatccatagttaacatcaggtttttaagaaaggtctcttgagtcatttgaacactggcattgtgcagctcaggtctcattacagatcccttttgttaacaggaaggttttaagtcagtaagtccgctggctgtaccatacattaagataatgagatgaaatgatataaattcaaatcatttggctcccttctccatctctatttctctctcaatttatgttacacaatgacataaagcaccaccttgggaggtgagcctgccctgtggttaatcattccaatacatgctaaaataccccacactataatttaacatgaagaacagctaggggttgtattggaactgtcatgactcacaggaatctactaattttgtcctgttcaccttcattttataactttgcaagagtttctgccaacattggcagaggtggcaaacgtaaaaaaaaaaaaaaaaaaaaaaaaaaaaagataaaaagaagctctttgtgaaatggcatcttgagtctatgccattgatagcgtctttctgattccccaggcaagctctttctgagccactctaagccctccagagacaatttcttttatgaaagtcaagcttccttctaccaggctctcacatcttcagcaacggtaatcattcttgaagctggaagtgttgtctgctatcttgatgttgctggtactgaaagaggcaaacaaagtcagcctgattgttttaggtttggattagtctggagtgcatagagaaacattttaaaaggcttattttgactatcaaagtgagttgatatgacagcagtcgtcaggggaaaaatgtgcaccatgcaaacacacaaacatccctcagcaaccagctgcagctactttgcagtagcaggtttgagggaaaattgctttcttgactatcactggaaaagagggcagcactccaagttactttggaaaaggtacaaccacaaagtggtatccaggatggcatggaggtcaaaggggtttgaaagtcaacttttatagcacataatcttgtagaattgtgtctgtgatttcatacatgcgtgtttctgtgtaatatgtaactattcattaatcagacacagattggcaggttctagtcagttacgtccaaacataatgataatcaacagaaaggaaagtgatttgaattaggaaatggggaaaaagagaaacaactaacatgcaacaaaataaaaacaacagcaaaataagctagtaattgctgaaagcagttttagaattcagctcaaccacctaaaattctgagtttatgaatggaaagctacctggactattctgatcatatcatgaggtgcctttttagcttggttattcaaatgacaaaactctcagtcatatggcagggaactgcatgactcttcacaaaaatatatgaaattaaaaacaaattttcggtctaacttcctagtcaagtttatatttaatgagtttgagatgccatgtgattgccagtttccaagagaaattcaatctcccagcatttattccacttaaatattgatgtctacctcacagtagttcacaatttacaattaccagctctatttttaagcaaaatataactactcactttgacacaaacaagtattatttggaaataagaatcctcaacatgtttcccaaaagtagacacagattattgcatgatgtgtgttccacatttttagacaccaaaacaaagcagggtaatttcttagaaaaataaaacttcattagaaaaaaaagttgcacaaaatattctttcatattatctgcagacaatgtataaaatcatattttaaatacttctcaaagcaaatattcagcatactttcttctacataattacatccttcaaattctttacctcttagtagttggatttctatactaagcaataaacaaattcaatttttattatagatataaatagttaaaagagaacataaaagtaatataagaagagtgcaaaggaagcattcatctagtttgagggacaggcgcatgatgtgtaagacatatgttcagaagctcctgtcaaggatgtacttctcttggcaaagtctgggcctcatatccacctcaaggtaagagctggtctgagactggcttctgcctgatcctctcctcagcaccaggaaaacgatttcagaactgccttgaagttcttgatctagtctttgaaacaaaaggaaatggatcctgacgtggtttagagtgggcctgctcctgtgctcttatagatttgtgttcattctctttatctcaaatcagtttgggacttaagtttgtaaaagaaacattattatttattcttcattatcatataaaatttgactcaatatttattcccagaagaacttttctatcacctcactgagatagccttaacccaaggttttattttcttctccccaggaatgccttttgagtataatggccctgtccagtggtcagagccactgtgatttgtagtggcagaaattcaacttgaactagctcattatcgttaagaaatgctcccaattatgggaaaggcgggcagaaccgagaccggtaacaatatgctatctgctgtccctgtttttctctaccagttgtctttcttctcccctgatgtaaaacagcttctagtacaacatacttccaccttttctccagagaggaaatggctttttctaactcactccgtttccaggtaattatggggggatggaaatagattctgactggcttagcttgtgtaaaactcaattctatgccaaggaggtgatatcttacaattatcagagtctctcagaacctgtacaatatgggaagaatgagctccccaaaagaacctggctgtggaaaaaggataatgagggtgtgtggccatcagaagaaagctaggggagctgagatggcaaaaacgagtgattcctcctacatcttcctgtactatggacagtttgtggcagctagggagaaaacttatcagattaaagacattcatatgtgtttgcattgctctgctctttaccaaatgtacccattccatgaagaaatatacaactacctgcaatggttgattttatacgttaacttgtctggggtagctggaacccagatatttgatcaaacatcattctgggtgttttggtgagaatgtttttgaatgagtttaacatttaaatctgtagaccgagtaaaccagattgtctccctaatgtgggagggccccatcaaatcagctgaaggcctgaatagaacaagtctgacccactcctgagtaagaaaaaacttctcttgccagactgccttcgaactaggacactggctttttcctgccttcaggaatggacataaacatcagctcttcctgggtcttgagccttccggcctttgcactggaactataccatcagctctcccaggtctctagctggccaacacaccctgcagatctttggacttgtctgcaaccataatcatgtgagccaactgtgtatatacacaactgtgtgtgtatacacacacccacacacgtcccattggttctttttttctttttctctggagacccctgactaatttgctaccctcctcgtgtgtttacattctctgtgagaagtcttaaagtaaagaaagaatacagaaagtttagataccccacttagggtgtgggtaccctctttactggatggagacagtgcagaaaccaacttttacttctcgaaaaaaagttgacatgttccaatgcagtctacaggagcaaacaaaaccccaaatctccaggttctggagtccactgggtaggaatgagtgacaattctattttgtcattaccatttgtattagtccgttttcacactgctataaagaatactacctgagactgggtcattataaaggaaagaggtttaattgactcacagttccacaggattaccaggaagcatgactaggagacctcaggaaacttaccatcatggctgaaagcaaagggaaagcaggcacattcttcacaaggcagcacgaggaagtgtgcaagtaggggaaatgccagatgcttataaaaccatcagatctcctgagaacttactcactatcatgagaacagcatgagagaaacctcctccatgatccaatcacctccttccctcaacacgtggggattacagttcccttctgtgacacgtggggattacaattcaagatgggattcgggtggacacaatttgccaaaccatattactgttgtatataaaatggcatcttaaggcaatcctcagtcttaagggctgagacaaaggcttcttattacatctcttcaaccctcagctccagctcttctgctattataactcatagagattttatgaaaattaaatgggctgtatgtaaaaatgcctacaaaacatttaaatacagaagcatccaatacatttaattttcttattttgcttctgtgcagaaaagaaataacaaagcaggcctgagactgctatccttaagtctgcctgcaaggttggtccttgcctggcatctgggtgcttggaattcaaaagtttataccattcattaatttattagattggctccctgtgcctaaattgtgcaaataatatggtttatgctatacatctggtctccacctgtgactctcaaatgtttgttaccaaagtgtgcctatctaaaaagccccccataaaaatatcaggtattgactctctagtgagcttccatgatagacaacatttcacacatgttgtcacagttcaatgctggagaaataaaccatgtcctgtgtgactccacagggagggaattcttagaagcttgtacctggtttccttcagacgtttccccatgtaccttttccctttgctcattttgctttcattgtaataaatcttagccatgagtacaagtgtacattgagttctacgggtcctagtgaattaccaagatattgttggggacacaacctgaccactatctttttggccacttcactcaaattcagctcaaccttccaaaatctgtcatatagcagcctatgccttatttctatagattctagacagatcacctttgcctaagtactgtaaacctgaatatatacccaaagtaattttgggtttagaatagcaggctttctttttatgataatgtgctattgggcctagttacctagctaaagaaaatataactctatgttatatgtataaattaagtctacatccttacttaagtcaacacatttggttatttttacatatgcaattaggcccaaaggtttctgtcataaccatagttactacatttttagtcaagagaagtgttaaggaaagtataaccaagatgcctgccgaaaccatgtaaaaacaaaaaataacaaacaaaaatcaataaaaacccatagaaagcctggctttgagtaattctcttttatgttgaaatctccaagataaatgaattataaaatctacatcaaagtgactagatgtagtaacttagtgaatgagattataatttttgctttgggccctttatacctatagctcattattttcctccactgataaccttaaatcctttattctcgttttttttattagaaaagtaaaatgaattcctgtattgcagaaaaagtttctttttgtttcaatctgtcagtaaaatctttttagttcaccaggttttaccacgaacagataatgttcttagagggtaatattcttagatggtagaaatgcaagcattttctctttccagaataaacaggttttaccagcataggaagtaaaatgccatcactcataaatagaaattaatatactaatttatgtggcttcagggagtcttgaggctgtggaagactgcaaagttaaataagctgcatccacatatacaacctctgtttttcttctgccaagggcataacataatatgcacttcccatgtctctaagagtccccccatcttcccaaatttccaacatgtatttgctaaagaatgaaacacaggaaaacgtcaaaacaggcaggaatgagacgctgtactgaaaacaggggaatttagtgaaatcctacccatttaccgatgaaacctgatgttgtcatttcacctcctctccctggttcatccactatgggcagacaggcctctgccctttttatagggagacaggagagtgtagttttctcctcttgagaaaacttgagaaaaaagaaaaaaaaaagacccaggcatttgtgactagcctaaacatagagccatattcctgcttggttatccaattatgaagctcatcattcaccctgtgccacccatatattcagggctgccaattcatgttttatgcttttttgataaatagcctttttattatttttattcataagcagcattttatttatgctttactgataaaatagtgacaagattatcaataaacagccaaacatcattagacatttaaaaactcccaataaatgaaagttagaggccattcccccaaccccacaaaaggaactcagattaaatagaaacataaaaccacaaatatgtagaaacctttaataggctcaaaaatagagaaaaagaaaccttcagggaacaaaaaataggtttcagattttaaaaatacaacaggaacaaagtaccgtttacagaacggttgaaaagtcaagttgaagaaatctcacaaaatatggaacaaaaattcagagaggaaaaatatggaaaaaaataaaggaacaagctaggaagtcatagacaaagtggcaaatatgtcaaatgaacaagcctagagatccagtgtacaacatgaggactataagtagtaaatatactgtatgtgagattcatactatgtgagtagattctagctgctctttgccaccagaacaaaacaaatgggtaattatgtgagctgacagatacgttaatttactttactacagtaaccattttactaactgtatgtattccataacatcatgttacataccttaaatgtacagaatatgatttatttttaaaaaagagatgatgcagagaaaatgggtaggagaaaactaattgaagaaattaaatgagattttctttcataactgaaagtcatgcacctccagatttaaagggcctgtcaaatgccagcatgatgaatggagaaagacccacaagacacatcaatgtaaattttcatcacagcatggataaagtagagattctaaaatatctagcttgggtcaggtgtggtaatcctagcactttggaaggctgaggcaggaggattccttgaccccaggagttggagaccaacctgggcaacatggcaaaaccccatttctacacaaaatacaaaaattagccagacggaatagtgtgagcacaggaggcagaagttgcagtaagcggagatcacgccactgcactccagcctgtgtgtgacagagcaagaacttgtctcaaaaataaataaataaaataaaagtcaacaaaatatccagcttggcagaaacaacagatgaaatacaaagattagcaaattgcatctcacttctcaaagtcagtactagatgccagaaaatactggggtataagactccaaaatcatttcagaaaatattttcaacatagaattctgtatattaacagatagtcaaccaagggttgaataaacatattattagtaattcaaggaatcaaaacacttacatttgtttatcctgcattaactactggagaatgtgctcaataaagtgaaagagtaaatcctgaaacagaaataaaaaacagcatccacaagaacagggatatcaacaggaaaaaggcaaaggacattcctaaaataatgacaaagagaaaacataggataaatgcacaagacctaccaaactaccagtccagtcggagcagaaatatggaacgctctggaggggatatctttcagaagaatatgaacctgtagtttacagatgtgtttgaacccagtgagaaaagtttgttctgtcaaagagcttgaagactatcttataacatatccatagaaaaactccatatgtcaaaaaagtaagatcatttttaacatttagtaaaaaaagttttggaagaaagggatatagtcataatttattatgtagattagctttgaattatatttatatatgcataatgactgtaataaatattgatttaaccaaaattttagatattactattttgagagaattggaggaaggaatgtttgtgtgtctccgtgtgtgtgtgtgtgtgtgtgtgtgtgtgtgtgtgtacctgtagaaagagagagggttgcatcataagtgaatcaatcctaatgtttcataataagatttcaataaattatgtcactatctctaagattggaaaatcaaaatataacagtttatattgcttggaattggtcaagtaaatgcaagaagaaatatctaaaagtgataagatcgatattggtatcagagtgatgggggtaggaagggatgagaaagagaataagaagactgccattatttacaatatcatatatatatatatatatatatatatatatatatatatatataaaataaccatatatagcaccaaggcttattatgtatatatttatatttgtagcaactgtggctactaatacatatatatttcatatattactttttatataaatatatgctagttaaatatttattaaatatatgcatatataactttatatatacacatatatgtacatgtatacatataaatatgttagttaaatatttaatatattatatataactttatatatacacacacgtgtgcacatgtagataacatgtatatataaatatgcatgtatatactatacataattttaaaataaatgtttaattataaaaagcaaaaagaaaaaactttaaaagttatgtaactagtttaatatagaaaacagatcatgagaaaaatcctaaggaaaatagaatttaaaagattaaactgtatgtaaaatggaaaaaaggaaaaactatagagaagaatctttaggaggaatatattttcaaaacctctgactaaattttagcataattcataataaatttgaatgcctgaagcaatatgacattcaaaaggaatttttttctcatgtctcttaaagcaaataaagggatccaaagtcacagtcttttgcaacctttattaaaatctccttcctgccatacatgtagcctctgaaatactagattacttgatgctcacagctactactcagatctattactcagaataatttattctaaggtcattgtctgcttcagtataaatgacataaagtgactcaaaattaacttagatgacgaaaactagtagataatagctttttatatatgttttatccaaatattgaaatttaaaataagccagctttctcacttgagtaactttaggcacaatggcgaattagcagcagaccacaatagctcattgcaagtctctgtctcacctgcctgccacaattgtagcaaataagacaggtgactatcatgaggcagaaatacatgacttggaattaaatggaaaggaagtaatttggattaaatgattattatgaacactgcagatttagaatgaaaagtcaagaattctatgttttacgtcaactaaaattttactttacttctaattaccacttcggatttgaagccactgcatatttcccattaattggtagagatagtagatagaataagaaatggattttagtagccagagttgaagttagggttaatctaaatgatctcataagcaattactagcattgtaccattatacagtctccactgtgccattgtaaggactgttattcacatctaagtttcagtgaatggcactggaggagtggagagtacagcttgaatggacatacatgtgacattgtttacaaatttccacatttcttttgcagaagttgtattgggctgttcttgtgttgctataaagaaatacctgagtctgggtactttgtaaagaataaaggtttaattggctcatggtccttccggctttataggaagcatgatactgctgtctgctcagcttctggggaggcctcaggaagcttactattgtggcaaaaggcgagggagagcaggcatgtcacatggccagaggaggagcaaagggatgcgggcagtgctaaacactttcaacaaccagatctcctgactcactgtcgcaaggacagcaccgagccatgagggatcctccatgatcgaattacctcctgccaggccccacctccaacactggggattacaattcaacatgagatttgggcagggacaaatgtccaaagtatatcagaagtctaggtgtatttcttcctttaaaaaatgggttttgtaaacctggaagaacaaattcttatttacagtagtgtgtccaaatgcactgaaaaagcttgatttcaaatatatcttgatttggagttgctaactcctattgctctgatactattgtgatctcagattttgggagtttcctctggggtttattattgtggctccagcctgtgatgttttgtctgttggtcaatgcagaatattcaaatttggaggaaaatttttctctacagtctcaagactttgccttatttctcttcacttaagactttatgaacaatggtttcatgatgacctctacagcccctgccctcaatagcttttgcagttggcatcttacctcacaaatatttaacattttcatattctttaaaattttttggcatgtttaagtaatagctcttccaggtttacaaaacccctttttcaaaggaagaaatacatcatatgcaatttccctaagttggttctcagtcactgaagcctgcaaaagctctaaaattagattccgtctaattttccaattatgatataccattcctcagtgagtgaccagggaaatctgcgtatggttgcttctaactattaaagtaacacattcattctttcagcaaataggtatgaagcatattctatgtcccaacctctgaactataagcttgggatacatccatgaacaaacagaaatatctgctaacacggagcttacattctaatgcaggggttaaaggggtaaacaagtgttgtcaaacaacagaaaaaataatagatatattaaataagtaaattatagagcatattagaatgcaaaaaacgtaacggaataaatggagccaggcaagggtgaccaagaatgctggcgactatagatcgactagggtaatcagggtaagtctcattaagaaggtgatttttgagcaaagatgtgtaagaaataagggagttttccaggcaaacatttgtaggaggagcatttgaggctgagaaaatatccagtgcaaaaaaccgcactgtgggagcactcctagtatgttaagtaagaaggaagaaaggcattttgcttcaagggtcttttttagctagagtgcccactcttacatttctttttctggtttaccctcaggctccagtgcatatattttgtctctgatcctctgagtaattagccagcattttaatgataatctgcattttcaattatgttagcttcttttgtttttgaacctctgaggaaaggtggacataaatacttccattgcaaagataaagaatctgataatcagaaagtttcattcctttaaagagctcaattccaaagtcaaaccccaaatctttcactctgagcccagtggtatttctgtcattgcctatgatatcacagacaaatcttgtccagattttctatcactaaagaaaatctagtcaagtctctacattgggagggtgagaaaaaaaaaaaagcaggcaatgatagaattcaaggaaagacaggaggcaggtcaacacacacacacacacacacacacacacgctttgagtgaaaagcaacacccactgtgccatcatcctggtatgaagaatacttgcactagaaaaaatctaactgcaatcctttctgacacacacacatacacaattaggaaacactcaaacactccttccacacttcattctgctctctgcctttggaggggcaaacagaagtaatctagcccaatgtacaatatataaatgtatagcaccatcttggctgaaagtccccatgcattctgtagcatgcacattgtatacacccaattgagtgtttcataaagttgtatgtatgtgtaaaggggaagggagtggttggattatttttttctttgtccataccaagggcaatcttgtcctctctcctcctgccttcattaacaattctctttctgtgtgtcttcaggtcccacttttaactagctctggaatatgacagtatcaattttgattccctataccctgatcattttcagtggtcccttttttaaacctgccttgaattattctaatttgagtatgccatctgtttcctgctggaaccgtgactgataaaagtgccatcttccgttcttctaagaccatagaaatgataaagtatgaaatgataaatgtaaaatgaaatatgttcatattgatattcatttggaaagatagcatctatatcgctcatactaaaagagggacacaaagggtaatctatcctgaaaagcagatctatagaatctcaagcttgcagtagggagttctacttctatagaataagggaggttaaaaagtgcttcatatgaggggggtaaagaggagtgggcctagactcactacgtgaactgtgtggctgagacttcccttctctatctgctagaagagaaagaaagctgtcttctaaaccttgccctgaattgtggctatttatagctgagacccagtgggaggaagtagtggacatatcctggcaaataaagatttgaggcaagctactaattctcagtgacctaaacgttctaagttactacgtcctaaagatctctgagttaccagtgtttgacatggatctggatagggacccctgggaagacaggtggaagcatttacagaactgttagtgattgtggtatttgagcaaagagagaggaagaataagaagaggaaagagaagaaggaggtttccttttctgttgagcaactgaaaatatatgaggaaaactaataatagtactaagtgagctagtagaatcaatcagaatatgagttctctccagaaaaaaaagaaaataatagagtaatcaaaaatggtttttcaaatggtacatattaaacagtgttatattaaaactatgataatcatatagagcaaatgcataggtttgaaagtagaccgattaaagttacagaagaagagaatagaaaaaatagtgaggaaaaaagttattgaagagatgttagctaagaaagttcttgagttgaagagagacatgcatacatcctcctattaaaagggtacgccaaatcctgagcaggataaatagaagtctatatatattcatattttttaaaaaaccttcaatgatttaaaaaaactcaaaattttacccaagataagtggtagacaacctataaaatactgacagaagaatttttcatcatcattagtagctagagaagagaatggactacgtaatatttttctacatgtatagtcagtatctttattatgtttattacttgaattggacaaagttggtgttaattttctacaaaccactgttgaatagagtttatgaatattgtctttgaatttagataatcctgacttctaatactagttccaattttactgatggtgagatcattatcaagtggcataattcctctgagactttgtttccttagaattaaagtggaggcactaacaattactttaagagactgttataaatattaaacttaagacaatctctggtgtgtggtaaatatttactttcttgtggccattataaccaattgactagattttcataatttttaataaaacaagtcagttaagaatgaaacttatttgtatatatatgcagaataaggacaccaaaaaaagtgagacattttagaatgtctaggtatttaccaaggaccattcccttaaagctgttttcattctataactacatttttccttcactcactcctcttttcattttaagatctcaccttacttaggttactttctccccatctataactttaacaatcatctatacactggtgctattcaaatatgttatcctagtcttacatctcttctgaactcgaggtctgtattcacaactgattattctatatatcaccatgggtaattcaaattcaacataacaaaaattaaactcagtatctctccttcccactgtccaaaactaccccttctcatatttccctttttgagcaaaatccacccaattgctcaaaaacgtgtgaaaaacattaccttctattttttcctcagttcctgcaaaaatgtgttaaccccacaagaacaatattaagaatattttacaacctggttggcaggcaccaatgtattaacacagatggcagctgtagtgctagggcaggatcaagaatgccctttgctaaagattccttgacccctacagctttgccataggtaaatctagagctttcagggaatggactgtttataagagtgggaatcttgagaaaataatgattcagcaaagactatggaaagatttcaatacttttactattagtatgagcctgctgatatatggcagtatcatcttcttttcttaatacaactgctgtttctctgtttcttatcatcatttgcctgtgcagttgcaatagtctacgaattgtaatccagagatccaattccttttctcctaagtctcctctagtgatgactcaaatactgccagttagtgtttttacttgctatgtttgataataccactgtaagtaaggcattataaacatagttaatacttgctttatctgtatttctttcccctttgacagtttgttgtcttttttctgtatcagatagtgtaagcctttgttaaaagctttgggcaacttttaaaaaataagttacaattttatattctttctttttaatatagaaatgatgtacttttactgggtgggtagtgggaaatagcattaaaagcaacactgcaagcagcaaaatccctgagccagctgcacaacattaagaaaacacctttaaaaacacatttttctttagcctgaagatttgaggaagaaagcatcacttatcttttactataaacaatggatttgtgcaatctcacatatgagactagatcttaattgatgactgcacagaaagtagtaaaaactcaatatttatgataatcccattctgtcattttagtttatagcattgcagatttttacatgacaatgggtcatatttagtgtttccatcacttctaggaggatttgaagatgtttttggctcaagcataaattcaacttgcatattattgaatcaacagttaaaccaaataaatgatcaaatagtaaaaccaaatgaatgatctgtactacctaaatgatggggatcattttatatgttttcaatgtgcacctagcttctatcatacattgatatcaacttcctacaaatttatgcagtttaatacccatttgaaagtgaaaatgatccttttacacacatctcaatgtaatacatggtggtcagccgatggtgggggtgaggaacaaatattttttgcaaaacttctgagcattctcctttccagtccaggtctctatacaaccattatatgcttttcttttaaaaaatatttttactattaatccatttattacagaagtacataaagccaatttccctgtaactgatagtctaaaacaatataataaattgcatgatttcattaaagctttgcacctgttcaacatcttagaccttacttttttaagcatccattttaaactattaatatttgtaattgccaaagtagccacttaatgatttctgtttagaagttattagtattataaataatactttaattttgtttaactgacacttaataattgtacatatttatggagttcatagtgatgttacaatacatataatgcatagtgaacaggtcagagtaattggcataaccatcatctcaattatttattatttatttgtgttgggaacattcaatatcctcctagctaattgaaactatgtaatcctaatattttatacctaaattttttttataattctgaatgtaattttggaaacaatgtaataggagattaaaagtcagaaccatccaaggatatacctaacgcgtatatttaatagaaacctaaagatgcctttctaatttcatttcttgaatttttagattaagcaagccaagcatttttacaagaaatgttacttcatcctatgttgtagttctgtcagtgttaactactgtaagtttcaattatattcagaattattaaatattaattataaaatggaatagcatgtatatatggcaatgcatagtaatatttattattgtcaccataacaattatgtaataatatttttatactaataactaaacctatttaatgtgtattttcaaaacaggaagcactatttcactcaaagaatgaactcccaacacttaaatttaaggcactagttgtaagcaattgaaaaatattaagcacttcaatcacatatgttatgatttaggtataaactaaatagaaataagacaaacattaaccaaagtggaagattttttcttatctatttttaaaattatatatgacaaattcattcttatgcaagattttctgagaaaataaaaattttaatattcctattagaattctatctcgatgggaatggcacctatttcctgacttattctcttctgtatcaccagcaccaagtaaacaatcaataaatatttgttgtgtggcacagaataggtattcaataaatatttatttaataaataatattcagtagaaatatgagtcttagaactacagaatgctgatccaacatattagacttcattttaaaaacatttatgaggccaggtgcagtggtttacacctgtaatcccagaacttttggaggccaaggcaggaggatcacttgattctgggaggtggaggttgcagtgagcccagatcacaccactgcacttcagcctgggcaacagagagagactctgtctcgaaaaaaaaaaaaaaaaaaaaaacccaaaaaaacaaaaatttatgagacacaaatggtgctatttttacatgaagaaagaattaagtaaacaaagagtatgaacaggccattaacaaaagaatataaacaattgataaaccccaacaaaatatttaatcttgcaagcagaaaaagaaatattagtaaaaacaatacaaataccttatttctttcttataaagttaggatttctggaagaaagacaatgactagtttgcatatgagcaaggaatataaaatcagtaccaattctaaataaatactcattcaacaattcctctttgaatatttaaataaataccaaaaataaaaaataattgtgcacagcaacagcagaccacagttatggtctctaaacaacattcaccattaaaaggaagcagggcaactcttagggcagaagtggctgatgtgaggtccaggcagggcagaagatcttgtcatatgagaaaacaagtaagttggattattaaaaactactgggtaatacccaaaggacacaagagccagctcagaaattcccactgaccaaagttgggacaattatggaatcaatagaaagaataaactacaacagattaagacacaataaatacatttaaatctgtttatcatcttttataatgaagattcagtatttaccaccccaaatttgaagcatatggttcaaaataataaccactgtttcaaaaattttaagtcagctttcatttaacattggaggaatttttaaaggaactactacctctaataagaaaacaagtatccttgatcaatttccaatttctattttatgtgttaaattcaattataattaatagttttattgaaaagatcatgtcttttttgaccccaattttgtctccttatctcttttttccttttatataaacatatataatttgagtttttcctcacttacattgcttacaattatattaacactgtggtttatttttaaaattgtatactttttaaatgagaaagagaaaagtaaactttttgaattgcaaaatatagctgaaaatacgtcaatgaattttctcaaaactgaaaagtagttttctattaatacaaacttttttgtttgtttctttttttgagacagagtttggctctgtcaaccaggctggagtacagtggtgcaatcgtgtctcactgcagacttgacctcctggatttaagcgatcctcccactttgcccttttgagtagctggagccacaggcacgcatcaccatgacaggctaatttttttttttaattagttttttgtagcgattgggtccctatgttgcccaggctggttttgaactcctgggatcaagaaattcttctgcctccacctctcaaagtgctggtattacaggcttgaaccaccatgtcaggcctataaattattttttaatgtgtagggtgatgacagaacaggtttatttccttcattggtgcacatcatttatatttacttatagtaagacagtgctattagtaatacagcattctttaaaaaaataaaatgttgatgaaattgttacattgcttcagttatatgattagatctaaaccagctttcattatatttcatgcaaaatatattatataccatgcatggtattttttcacatagtatttatgttgcatgaaaaataccatgcatgatctctggaacctgggagactgcagtaaccctctatgtttctaaaatatttttaaatgatttattaataactcaagatatttctgcctaccaagctctttttttcctctgtttatattccatttttaataatctcacatttctaggaaaattaggtgatattacatttgtatatcttatgatgagaatgattgacaatattttaaggttgtattccaaagaaaaatctaataatctaaataattataattacagccactaattcagatttattagagatcaaatgtgtaaccaaatttgcagagaaatagaaaatattagtacgtgactgtatttgtttagcttttaaatttgaaatcaattacccatagtattttattacaagtgaattaatgatatttatgaatgcatacattcattaatttagcacttaaacgctaaacattcacatctcccaaattatttattttggttacattttctttttaaaataaataattactcctatatctttttattcaaacttagatcctcattaaaaacaaactttgaaactcttgtttttgttatactcttgtttttatcagtaaatatatagaaatatttctatctgtttgcatgttacatgctcacatgccatattagcccttaatgggctatcattgacctaacaaatcacccaatactgtctacctggattaagaccagcatctatagaagccttgataaaatgaccctctcttctcagtccttttatatatcaaaaccacatagacttcccagaaatgttacagataaataaagaggccataacactgttttagagaaactgatattcaattagtcagggcttcttccaatatataatgttaaatttgacagcaatgtatttatatctgttaataatttaaccaatcttagaactccactgaaattactttttttaaaaaaaatttacctttattgaggcataattgacaaacattattcaatgtgcataaagtgatgttttgatatatgtatacattgtaaaatgatttccacagtcaagctaattaacatatccatatacttaagactagccgggcatggtggcaagcgcctgtaatcccagctacttgggaggctgaggcaggagaatcgcttgaacctgggaggtggaggttacagtgaaccaagattgcgccactgcactccagcctgggcaacagagcaagactccatctcaaaaataaataaataaatataaataaaaagatttactgttagcaaatttcaagtatacattattattaactatagtcaccatactatacattaggtctccagaacttatgcatcttataactgcaattttgtactcttaggccaacatcttctcccatttcccccacccctcgattccctggtatcgacccttctattcactcttctgtatgttcaacttatttagattccacatgagaatgagataattcagcatttgtttttctgcgacttgcttattttctttagcgcaatgtcctccaagtttatatatgtctcaaatataacaaaacttccttctttttttaaagactgaatgacagtctcttgtatgtgtgtatgtgtgtatcgcagttattttaaaggacgtgcataactcagaaatgcacattccatagtgcttctcaaactgagcaagtataagaatcacctgggaatcttattaaaacacagattcctggggccagcctacaaagattctgattacgactgagttcacagccagggtgaggacccccataatttgtattcctaacaaggtgctgggtggtgttgatggtcatttggagcaactagaagtctgcattctcagtttaatttgtcttgttccttaaattaatttggcactaatctttgttaatcagtcttttcccttcccacacctctccgttactttaaagagcatctcctttgactttagattttattttaaaatgtcctgggagctactgttcacatgttattcctgtacccaggagatgaccttaaatatttgtgcttatcatttcatttcaagaaacactaacattcaggcaagtttaaatgatgtatgtcttggtttattgtcccctacgtcctattgtccaaggccctgttggagttataaacaattttatttcagcaccacaagaaaaacttgctgttttaggttttaatgtttatgtgccacagtccaagagaaattattttttctgataatgcctttgaacttcaaaagccctgttcctttaataaactttttagaatgaaattatgcaatattcatcttctagtcattaagttctatgagatcatgttccataaatttaacatttcatagtattaaggttggttcccagcctatctctaaatatcttttccttgtttattgcagtattttagcacttgatagcagataataatagcagacgtcaacattctacaaatcatttctaggatgaaaacatttttaataatataaaaccagtattccctgagcatctggcaccagaatttctcttagaaagcaaaaggtgtttttctggaaacaatcgtggtaagtcattggagattgaaagtgacacactgatagagtccaagaaacaacaataaaaggcattttttttttttgcttactctatacaaagcaagtgcttatccatattaacaaagttaattatcataactactttatgtggcatgaattctataatccttcattttctagatcataaaactgaagtatagggaggttaagtgacttaaccaaagtactgcaggtgtaagtggcaaagctgggatttgaaccaactcctcagtccaaatattcatcagcatacaatgctcctttatctgataacataagaacagttttgcaggtgtttgctgtcggtggttggttggttggctggttgactgaaaaagaaaatgtgggagtgggtgaagtgagaagagaaaaagggaaccagagatgccaaaaagctggaggatgatgaggtaaggtctctatttttagtggcagaatgactgtagaaaagtgtttaatatgaaatagatgcaggacttttcttggcccctttgccagattcacagcaggggcaacccttctactccgcctgctcaaccccattgcgggaaggagaactcccttgcaggaattgactgcaggatccagccagaagctcccggcgccaactcaggagccagttccaggcagggccatggcaaggctaggtgtgtcacctcgaggggaatgcggcggcacccaggtgaatgtacctatgaccctgaagtctcggaggggatgtgacagtgctcctttagatccaccgtctgcagacagcagtgtgtaagcagctcagttggccccttgcctcgttgcatggggtggctgccctccactggcgagggcaaagggctgatgtgatggcctttctgggtacccacactcggtgggtcccgagctctagtcagtgtccaagaagagtgaggtcacatagatggagaaggcagagaactttattgagtaatgaaaatggctctcagtggagaggggagctggggaggggatgggaagggctggttgtctcctcctctgccagctaagtctaggcacaggatggggagtgactgctgattgctttgtgagtatacaaaaagtgttaaagcaaagacaccactcaaaggtgggcacaacattgtagaaaaccaattaggaaagggtaggtataagtaaaacaggtgaagggtggggatcaatcacagggaagcgtgcctaacaggaagacaagttctcaacccggtctgaggattatttaacctgtagcttggatttcaggctttaaactctcttccccttggaggtgggatttcactgggtacctgcctctatctgcctaagcatttggctgcttcctgtcattatcaaaatgagacattattttgctgagcagtgcacattgtggcctctcctgatgactccccaaatcagcaatcttgtaaaaatcagtgacagggcagagtttcacatctgggttaatgttgaatgttgtacagaacagagatttcatggggtggggctgtgggagcagaaatagaggtgatcagcagatcagaagcccaggtaggctcaagaaatcttgggtcaggttttggactttcaagctatagaacagtggttaaaataatgttttctaaatattgagaggaagggagctcccagctaatatgtgtatttcattttatgattaaattattgtgttttctctactgtaaactaagggggaactcttattatctaattttaacgatagagcaccatgcccagcttgaggaataccataggtacttattttaattataataaagtatatgaatacttttatagttaaggtaagaataataaacaagaatattttcaaagatcttcctttatctgtgggcaattaagttttacttgggtagatcattcctgttttagtttactttcaatctttaggatatcttgaataattgtaaagatatcttttcatgacatgtaacataaacaaatcttttttcttcatatgtaaagccaagattttcctttcttactcatacatgtggcaccacagcccaaatcaggacaggctggttgaacaacggacattcccaggctgatgacctgatttactctgtgcattggctgttattgtgcatctgaggccatctgggctcctgagggttcccaggcagaaatttagcaggtggggcctcctggtagagtcgatgagagcactaataagcttgtctcagctggatgatactctttgcatatctttgcatttccttgttcttacagggaactgccttcaggagaaaattcacccaggtcaccaattaccgtgctccccagttggtttgtgaatgcttcagcagacttatttgttgcacacaactaactttttttgttacatacccttagttttcacacattaaaaaatacactaagaaacttaactctttgaaagaggacattttcattcatttcttagtttgttaattcaacaatcaataaacttttattgaagattcaatatgctcatcatcttatgctaggcattttagagtggaagatataatagcatattaaagatcttctatgtgacagccaatgtcctaagtgtttaaatccacaataatgtttaacttttatcacaaccatataagataaatacctgacacgcaagttgggaagttgaggctcagagaagttcagaattttgctccagtttatacagcatctaagttgcaaaactcagtatcacctctggttcaggcgactccaaggcccatttttaaaaaaatttgtgccagttataaatggttctggctctcaaaaagcccatggtttagtgatatatggaactcaacataagaaaaatcagtatatattatgtgttataataacggcatgatcaaggtccgtgaacaaaacaaatataaataattccatattgtgcgcttttcactggggatgctagaaattgctcccggtttttcagccaagataaaatcagcattccaagcagagtgaacactaaacaaacagacaaaaatcagaagcaagaaagtgcaatggtagctttggggcagcctctagagctcgctaatggaaaagaataaagggttgagtatgacacctggaaataagacttgaggtaaaatcaagaaatgccttgactttcacagttatgatcagaaaacatcaatgtatagtggttaccagacatgagcactaaggaaaactcaacctttaatgcagtttcttacctcagtgtacaaattatctattgacagagaccacccaggttccaaggatttcttctatcttgtgcaacttctccagttaacatagactagatttcactacatcacttggacatgaccatattattctagatcatgaggtataacaagccacaacaatacacttgtactcccctcagtttcaaaatttatgttaccttagtggtggttgagataatgttcaatttcctttgagaaatatgtagaaaagcaacactcctaaaacagagcctttttcagccttctgattctattctcacatattgcagggtaaagaggaaagaaaaagaaggatggtcagatagatgagtgagttctctggtacatgtaaatattcaggtgactgtgtgtgagacagagaggcagagacatagagagtgagtgcaggtgtggtttcccttctcaacctgtattttgtaagtatgctaagtacatccattatagaataatcagtattttactcttttagtgaagcctttaagttaatctttatgtccaaatacataattatatggtgagagtggaggtaagaaaaattatagttttaaaactaaacacgtattatataggtaacaaaaattagaattttaaaactaaacatgtattatataggtcttgaaataactcattaaagtttttgattgttctttcttcagatacattccatgttcctggttgttttgaaatgttctgactttttaaaattatactttaagttctgggttacatctacagaacgtgcaggtttgtcacataggtatacacgtgccatggtggtttgctgtacccatcaacccgtcacctacattaggtatttctcctaatgttatccctcccctagcccccaccacctactccaggccctggagtgtgatgttcccctccctgtgtccatgtgttctcgtttttcagctcccacttatgagtgagaatatgtggtgtttggttttctgatcttgtgataatttgctgacaacgatggtttccagcttcacccatgtccctgaaaaggacatgaactcacccttttttatggctgcatagtattccatggagtatatgtgccacattttctgcatccagtctatcattgatggacaattgcgttggttccaagtctttgctattgtgaatagtgttgcaataaacatacgtctgcatgtgtctttatcgtagaacgatttgtaatcctttgggtatatgcccagtaatgggattgctgggtcaaacggtagttctagttctagatcctcgagaaatcaccacactgccttccacaatggttgaactaatttacactcccaacagtgtaaaagcattcctatttttccacaacctctccagcatctgttgtttcctgactctttaatgatcaccattctaactggcgtgagatggtatctcattgtggttttgatttgcatttctctaatgaccagtgatgatgagcattttttcatgtctgttggctgcacaaatgtcttcatttgagaagtgtctgttcatttcctttgcccatattttgatggggttgtttacttttttcttgtaaatttaagttctttgtagattctggatattagccctttgtcagatggatagattgcaaaaatgttctcccattctgtaggttccctgttcactgtgatgatagtttcttttactgtgcacttctttagtttaattacatcccatttgtcaattttggcttttgttgccgttgcttttggtgttttagtcatgaagtctttgcccatggctatgtcctgtatggtattgcccaggttttcttctaggatttttatggtccttggtcttatgattaagtctttgatccatcttgagttgatttttgtataaggtgtaagcaacgggtccaatttcagttttctgcatatggctagccaattttcccaacaccatttattaaatagggaatcttttccccattgcttgtatgtgtcatgtttgccaaagatcagatggtggaagatgtgtggtgttatttctgaggcctccattctgttccattggtctatatatctgttttggtaccagtaccatgctgttttggttactgtagccttgtagtaaagaaatgaaggcagaggctgggcgcggtggctcactcctgcaatcccagcactttgggaggctgaggcaggcggataacgaggtcaggagatcgagaccatcctggctaacacagtgaaaccccgtctctactaaaaatacaaaaatttagccgggcatggtggcgggtgcctgtagtcccagccactcaggaggctgaggcaggagaatggtgtgaacctgggaggcggagcttgcagtgagcagagattgcaccattgcactccaacctgggtaacagggcaagattccatctcaaaaaaaaaaaaaagaaaagaaaagaaaaaaaagaaatgaaggcagaaataaagatattctctgaaaccagtgagaacaaagacacaacataccagaatctctgggacacattcaaagcagtgtgtagtgggaaatttatagcactaaatgcccgcaggagaaagcaggaaagatctaaaatagacaccctaacatcacaattaaaagagctagagaagcaagagcaaacaaattcaaaagctaacagcaggcaagaaataactaagatcagagcagatctgaaggacacagagacacaaaaaaccttcaaaaaaatccatgaattcagcagctgtttttttgaaaagatcaacaaaattgacagaccgctagcaagactaataaagaagaaaagagagaagaatcaaatagacgcaataaaaaatgataaaggggatatcaccaccgatcccacagaaatacaaactactatcaaagaatactataaacacctctacgcaaataaactagaaatctaaaagaaatggataaattcctggacacatataccctcccaagactaaaccaggaggaagttgagtctctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaagttgagtctcttaatagaccaataacatgttctgaaattcaggcaataattaatagcctaccaatcaaaaaaaaagtccaggaccagaaggattcacagccgaattctaccacaggtacaaagaggagctggtaccactccttctgaaactaaagagggaatcctccctaactcattttataaggccagcatcatcctgataccaaagactggcagagacacaacaaaaaaagagaattttaggccaatatccctgatgaacatggatgcgaaaatcctcaataaactactggtcaaccaaatccagcagcacatcaaaaagcttatccaccacgatcaagatggctttatccctgggatgcaaggctggttcaacatacgcaaatcaataaatgtaatccatctcttaaacagaaccaatgacaaaaaccacatgattatctcaacagatgcagaaaagtcttcgacaaaattcaacagcctttcatggtaaaaactcttaacaaactaggtatcgatggaacatatctcaaaataataacagctatttatgacaaacccacagccaatatcatactgaataggctgtatatttccagtggaatatgggtaagaaaatggtttttacacgtgctatctcttcattttggaattttaagattttgtcttccaaaatcaatgtctttctgtcttgttgaatcctaccatttggcacagactgagtggtcttttttcttcaggggcaggggccaagataggagatgggtaatctgaagtttcctgtgttttcctgtgtgcaaaactcataaacagccaaaataattgtatactgttattgtatgatctgtctttagccctctcctgaggaaaggctatttcaaatgcagccatcttgaagattgtgagttctatttttccccagcaaagagaagttaatcatagtaaatgcgatgctttcctttctaagcatttgtggaccatacactgataggtattttgctgaatttgctatgacaatagcaatgtattacatctagacccttgtgcacagataatatcagaagctttgtgccaataggataaaccacatcaggatggagagctaagttgatatcggtttccacattttgttttaacgtcctgctgaaatgtctctgaagcttcacaagagagtttgctttgatcaacattcctcaaccttcaaaggaatcttggaagtgtttgtgagacagctgtttgctgaaataaccttaattgcttgtactaagaattatcactgcatgcctcatagatttgtgagaagtctgtaaaaaaactgctgacattggcaccaaagttcatctaccttcaatctacaaagtacccccctcactatttttaatgagtggtacctcatctcattgtgcacacatatgtgcccaaatataagtcattggtgatactattttcttatttttaatttttatacaatgtttctagtacaaaagtaatgcatgctcgattatagaaaatttgaaaattcaaaaatatgagaagaaaaaatatcctctctgaaaccaccattaaaataaaaaaaaagtctttctagtaatttgtaatatgaacagggttttggtttttatattgttaaatatagtcataataaaaactatccagaatagagtgtcctggtttatttttaagtaatcacataatgtatgccttttaacagcaaagaaaaaaaaatccatcccattggctttctgactaaagttccccttattccattaacagacttatatagtcatgttgagttccccaaacattaccattaccccctgtagtggaaaaggaaaaaagccaagttaaacagttggacacttgaggaattgttggtttggaacacataaaaatcaacttctgaattgcagtttctttattatttgacaaaagaacacgctggcctttaaagtattctgaacattgcactgcgtacagagaaagtgagttttacagtcaccattggactgctcatagaggccagatttttgaggtgctgggggaaataattagcaccctccagggatggactatgggatagtaatagagaaatcaaaagccatacaaaggaattggaagatataaaagtcagacagttttaagaagatttttaaacataacagtgaatgaaaaagacaataacaggaggaagacagaaatctaatatttttatttgatacttgggccagacatcgtggtaggcactttccaaatgtcaccttatttaattttcacaaccatgtgatgacatggagcaatacattgaagcaaaggatattaactaacataaccatttcttatagtcagtgatgacagaaagctatctagtagacttttgaagcaaatcaaatcagaaaaagattttggagagattttgcacagataatcaattgcccaatgggttattcttgcccactccccaaagagagctcatttatcaaggcaggggaattacaattgtgaaagagttttacacaaatagggccagctaaatgggagattggagttttattattattcaaattagcctccccaagaacttggaggctagggtttttcaaacaaagtttaggagatgagaggaggggtggctaggcaaggggtgcttgctgctgactggtagacggtacaatcacaggggtgtgggaaaaggtcctcttgcaagctaagtcacttctgggtggggccacaggagtggttggtgggtccaagtgtggctattagacttttagtataagaagtaacattagaggctgagtgtggtagctcacacgtgtaatcccagcacttagggaggcagatgtgggtggatcacaaagtcaggagttcgaaaccagcctggccaatatggtgaaaccccgtctctagtaaaaatacaaaaatgagccaggagtggtggtgcaagcctgtagtcccagctactcaggaggctgaggcaggagaatcgcttgaacctaggaggtggaggttgcagtgagcggagatcatgccactgcactccagcctgggtgacagagcgagactccatctcaggaaaaaaaaaaaaagaagaagaagaagtaacgtgagaaataaaaccagaagtcagaattcaaacttattcacactgtcaatacagtgttacagacaaaatgcttacaaatagaatctggtatgatttcattatctaagataacatatggaagttatgtgttttttaaagtgttgatttgaaggtataatctaaaacattccaaacatcaagtcatgaaagcagtttttatctgttttgtaaaaaaaaaatatatatatatatatatagtctatacaccaaaaattataatatattcatttaaatttctttgacatcaataatactttttcttatatatttatttaacatactttaacaaattgaagacattttttgttataagtatgactgcatattacatttaattaactttattgcattaaatactatcctgatatgaaataaaatacttggtttataatgtcttcttatagcccaaactgaaagcttgaaattaattagaaatttctataactgttcattagattttatatcactatggaagaatttagcaagttaaaaaaaatacacagacaaaacaaaaacaacaaaaacagagggtgagaaatgctggattggaggctctccaaggccttcctattctgaaatgccatcatgtgcagattctcatctttcctacacccactaactgaaggcattgacagaaagaaatgaaaaagggaagatatgtaattaccctggtggatcgattcactcataaggtataaatcaaaaggaaatgcctggattatttttaagaaaatctgtgtactccaaactgcagatgaaccttcttgaacaaaacaatataatacaacaaaatgctaagctcattagttatgcataaatactagttcttaaaacaattttaactatcagaactttaaatttgccagagatcaacatgttctgccaatgttggctagttaacaaagttaatatgtttagcatctagtaaatccgaaatggcataaaatgactgatgtatgaattgagtatgacccctggtcttcctctggattgaaattcctcttgcattttcgagaaattagtaaagtgtgctaggtaagtaattaatgcactttggtgtgagaatttggaaaattattgaaaaatatattaaagggttgaattctgcattatctcaaattagctaatctagttttttggcacaaaataagcagcctgctttgtacacatttggaaggttttaaaaacaaatcaatatagccatacactcaggactatgctaaacagagctgctgatacccgcagtgctcctccacagtgggcccattgtggagagctgccacattcaaaacaccttccagctgttggaggaaaccacaagaggggtgaggacagacgcagacaccctccatcagataattaccttgattaagattctctgaattaaacggagtttaatcaaggaccctgtgaaattgtgaaaacgccagctttctgtgcttgccctccttttctacagatggtgagttgccaaacaaaatcaaaggagtcttaattacaaggatgagaggcaaagtcaaagggaatgaatctgtgctttgtgatggagatggaccagcaccaatcagcagcaaactcagctctcgtctgcatggagagtgcgacaatgcatcaaagctgaacacactatcaacatccttgacaattcaaaggactgaattaatagccatgacaatgtatctaaggtagtagttaacattgactcttcatatgatataataatatatgtgaccttttatggcaacatttggactgacattagaaaaaacaaccatgccacttcagctgttactaagaaagcatggcccagtttgaatctaaactaaaccattactgaaagtaaactcccttttaaatgaaaaaattaaaagagcaatgacacagggaggtcaatttttttttcagtttttctgcttcctcttattttgaatttggactataaatagaagtaattataaaaatcatccattccatgacatgagttgataccacctagcatctactcactgcaacactaatatcctttacatgcatactatcagactttctccactgtattatatgtctgatctttttgacatccaacaccttttacttctttcttaagtttttatttatttaagttcatatttatttctattagttttttaaataaaacttggtccattattacaagtaacgtcaatgaattatcacctagtagtgctaattaattgggtggaaccaccacttcaaaaggagtggaatattataaaaatcattgtatcccctcccctaatcatacttacaatcatatatcttctaacataaatgtcatgtattttgtaatgttttctaaattaaacatatatctagcttctctgatattacaagtcacaaatgcaagtggttcatggaaaatctgtttccctgtaagttttcctcttttcaaaggaaatctacaatttctatttctaggagcttgcatttttaaattattttgtttagcccttcaaagatttcctttcaactattatttatatatccccttccctttgagatctaaaagtttattttgtctttttctcaggttctgtaccatcgcccttctgtattctgaaatcttatgagtgatagattcttatatcttgggcatcttattcttgtgatttatttttacatgcatatatcttgtttttcctgcaagcccatctctacacagcatttttgcaattcttacttattcttagtttgctttccttcaatcttttcttcttatataatttgctatcatattttcccaaaattccttttgaagtaacttcttacagtattttcttaatattagcaagaaagagaccttcctctaatcatacaaacatgttacatgtttgactgggtcttttccacaccttgaaagatgcaccaattgagtgatttgtttcctcttctgcatactgaataccataagcacttttcatcacactttaaacaagagctatgtatccttttattacacactcaaattttcccaactgcatattaaatccagcacaatgcatacaatatatcaacatatgagaagtagcatgacatcagtttagaagtaaagaaacatacattttagcactaattcaatcactaattttctttggacaatttaattgtccagactttggacaatttaataagttactatgaatcagtttttgttttggtttggtttggcttggtttcatattcactaaggaacacagttactataatttggatacggtttgtttgtcctttccaaatctcatgttcatatttgatccctgatgttggaggtggggtctaacgggaggtgtttgggttttgacatgatgttatccgaaaccagtcaagtaaaacgattgatttgttataacacttggattttaagtgaatatgtcatccaatgtagccttcaaaattactttcaaaaaaataagccttctaactttccctctacaattagctccaaagaaaagggatattaataaattttaaaactgtttaaaaatttgcacatatctttttaaatgttgctctctgtttaattttttacaacttgaattttatgaaaatctattagggattaatttttaaaaccttccttttatttacttttaaactggatgggaaaccataggaaatacaactgcactcttattaaaaactaaagctgaccatatcaagtattaccaaacatgtgaggaactgaaattctcattcactgctggtgggaatgtaaaatggtaaccactttggaaaacagtttgacagtttcttacagaattaaacatgtgcctgacatatgatccagccacctactcctacatattaactcaagacaaagcctatgtccacttaaagacttgtcattaatgttcataatagtttcatttgtaatagcccaaaacggaaaacccaaatgtccatcaagaggttaactcataacagatgaatgctaaaaacactgatatatatcatacaatggaacacaactcagcaatacaaagaaatgaactactcatacatgtggcaacattctgaatctcaaaataattatgctgagtaaaaaacccagacaaaacccagacaacaaaatccatactgtataacgtcgtttaaattgttatagaaaatacaaactattctatcataagagagagtagaacgctggttgcctgggaagggccatgtggtggtgttccaggtagttatacaggcatgagcagagcaggagagggctctcccacccactaggaatgtcaggtgatggcttggcaattatcacaatgcctcactaaaagtgataagttggcagccagcaccagggataggccatttcctgatggttcacacctgttgcactgaagtgttaattgaatgcaggcaacagggagaaacaacttcctgggcatgcccattaagagacaacatggcagagtatgactttctgggggaactccacaggaaaaaggaagaaagcctccgatgggaatgcatacaacttcctaaacacactgcatgtgctcacttcccaggggtagcaggggcactgcacacgtgggcagcccaccctaaggaaagaatcgtgggaaaggggccagcctataaaagtcttaggatcgctgttaaacagcacacttggccttcaggtgcctacttgagtctcttccaagtgaactttcctttctttcctgttctaaagcctttctaaataaacttttactcctactctgaaacttgccttggtctctttttctgccttatgcccatgagttgaattatttcttctgaggaggcaagaactgacgctgctacagacccttacagatttgccaccataaacactgatatttgccactggtaacagaggtttaggaagttgtatgcattcccatctgaggctttcttccctttttcctgtggagttcccccagaaagtcatttgcccctggtaacagaggtacaaaagtgagcaagggaaaccttgtgggtggtgagctatgttcatcattatcttgattgtgttaatggtgctcatacgtcaaaatatgtcacactgtacactttaaatatatgcactttactgtatatcagttacatattaataaaactgttaaagaactggaagtgaagaaacgttattccacttaacagttggaaaataaaatttaacttatgtatggatgtcatagtctgagatagaaaaggcaattttgtcttcatgacttttattggattttgcaaaatattctaaggtgaataaaattagaatcatgatatctgcttcaataatcacattaatttttttttttttcagagagatacagggtttcactctgttgccctggctacctggagtacagtgttgcaatcactcctccctgccgtctcaacctccaggacttaagtcaccctcctgcctcagcctcctgagaagctgagactacaggtacgcaccacaccaccatgtctcagctaattttgtgtgtgtgtgtgtgtgtgtgtgtgtgtgtgtggacatggggtctcaaactcctggtctcaagctatcctcctgcctcacttctcagtgttgggattacaggtgtgagccaccctacccagccctaatcaccatttttttgaaggtaaacaaacattcctttctgaccaaagtggtcatgggcacaacacaagctgagaacactcaaaccagtcagtatagaacgggtccccacagaggtcagcactgggagtccattatcaggaaataaggaggaaacaagaatcagtaaagcaaagtggctgggagcattatgtctccagcagcatggtgtgttcagcaagatatcctaggtttcaattctagcactgtcactcacttgcactataacttggcagattaggaaactacttcaatattcagttagcttatctgtaaagcggggatgataagagtacctagcacacagagccgtaatgaggaataaacaaactaacatgtgtaaaacacttaggtatttagcactataaaatgctagctattattggtagttcagggaacctgattagcaggctatgaaactatcagttaactctacactagatttgaaatctaaaattttaggaattgttaaatgtaaatattgaactctccttcagatttgtatgctaattagttaaaaattatttttggctgggcgtggtggctcacacctataattccagcactttgggaggctgaggtgggtggatcatttgagctcaggagttcaagaccagcctgagcaatacgatgagacctcgtctcttcaaaaaattaaaaaagaaaaaatagccctgcatgaaggcgtgcgcctgcagtcccagctactagggaggctgaggtaggagtatctcctgagcccagggaggtcaaagctacagtgagctgtgatcacaccactgtactccaacctgtgacagagcaagacccagtctaaaaaaaaaaaaaaaactttactcttatctaaaaaaaatactgttttgaaagatgttgcacttaatatttatttgaggtacttcttcttttgaatttatacatctgtgttatatccatctctattgccatcttctcccaacctctgagtgttggagtttctggggccaatttaatattactgagagtttaggtagttttgcagagcatatgaaccatatcccaaaggcaagctttcgaaagcaccatagaacaaaatcatgaacaacatactaagccaatcataattctgattaattggtactttggacaaggaaagaaacatatcttgagtttaaattataaaagtaattactaaaacagacaagtttagttggcctaagtatgtgtgctgataaaccttaataaatcagactccttcaattctttctctacttcttgattttcaattaaataattctaggagctctgtttcttgattttatactctcatggaaccatgacataaagtaattcagtgcagataagaaactaggtttaaagtaacttatatataaaactgttcacaaaaccaacaactatataaaataaggtttgtatttttccccaaactcttaaatttactcagttaacacctagtgataaatgtacttataaatgtactgttacaaaaagttactataagattatcatttccctagtatatatattaggatctgttgacttttagtggaaaaaaaatctcaataaaaggaaagttagtatatgtgtgtacttggaatgaaactgcaaatgaaacagggaagttatcagtttcatttccatgatccctaaaacagtttctggaacattaaatagagcccttgaaaatatttgcataaaaaataaatagtcaagaatcaaagaaactttggggaccatcaactccctattttctctcctgatcttatactgtctttatatttctctttccccaaattggtctatccccacaacactttccaattcaagattccagaaagtaatcatctggctgctttagcatcactcttcactcttactaaactccacagctactagtcaacctactaacggggtctactcttaaattaagtatctactccttgttcaaattacaagcagttctagtgaaagaacagcctagtggtactatccggagtggagcattgtaagtggagcaatacattcttagaattaatagccacacttgagcttagtgcaccagtacctgaaaagagaagacagacctatctggcaagttgcagggagtttatgacattgagtccctgatataatcaatgtacctttgaacaccaagagaaaacatggtatgatacttgctaaagaaaactgcaagaatgagagtgggaaggaagagtgtaacaataactatctaaatgacatcaaccaaaaaaatcataatgtatgcaagtcagattgtcaaatgattttaaccactcactttaactttgtcaaattttggctactgacagagtagctaatatttttaccataattttttgactttttcatataaacactttgaacaaatgatctgttctttaaaatatttttacatggaattattcaaggtattcactattactatgttcgaaaatgtgatgttgatcgtatcctggatcttttcttgagatgacatctctagaagtacaaggggagaataggtttatgttgtcagtttacaaaatttttatttttccctgggacaaattataccatagcaaagttacataatcttctaaaaatgcttaacaaactagggagagtatataatcacagagaaaaaaaaatgacccttaaacatacacaaatgttaaatcatgtaattctaaaactttcaactcaaaaatgactagtgaccttatgtgttatgtagcccaatcctttaatcacataataggaaggagcttcaaaaatattaatgagtgctctttcagcaactgataaaataaatagagaaaaatattatagaaaacatcatcaacaatcttgacctaatttttatctatagaaagctacatataacatgtatagaatatacattacttttcaaggatatgtggtaatattcaccataataaacagtgtgctaagcaattaaaacacttacacataaatttaaaagacagaaataacacagtgcgtgttcactgatcacagtgaaattaaattagctaaaacaataatatagctatggaaattcaagatatttgaaaattaatacatttttaaataattcacaaggttaagaaagaaatcttaagataaattgaataatatttccaaatataatgatgatgaatccataacatataaaaatttggtggttgcagctaaagcagtacttacagaaaaattaaaaaggtttaaagtcaagagaaaagtagtctaaagtcaaatgcctatgaatatacttaaagatgtaaaaatatgtgcaaagaaaataatagaaaaaatttgtaaaagatgaataagaggaaaaaataataaatataaaattttgttatttaaaaagtaaacaaaattcatacagtacattctaaattgattaatatgagaactggctcacccaacctactgccactactactaaggcccgagcctacaattcaggatcctagggattgatctgccttgccgatcacagctgggtgcccacatgcaccatcagggagtatcaggacagactcacccaactgtagcctctgctgtcagtacccagtttactatctgggggcctgggaattgaaccaccctaatcactggtaccagcactcacacacaccatttagggtcctgaggacaggcctacctctcccaccactgctactgcgagggctcatttatgtcatctggcggcatatggatcaacctgccccatctgccactgccaacacctgcacttgccttctaacggcctaaggaggggcatgcttcactctccactgttgttcttgtgcactatctgtaggcctgggaataagcccactctgcctactggcagcacaagcacacaattcctggagtcccaggaactggcccacctagcttgtctccactgccaccactgacattggggagcctgagaactgacccacaaagtttaccaccaccaccatcacacttgtgtgtgtcacttggggtcctgagaattggcccactgccactactatcactgcaaatgccatgcacactgctgagggactgcaggacttactcacttaccccactcaccactactactgccggtaccagagcaagccacctggaggcacaaaaaccaccccactaggacccactaccaccagctgctgttactagacgactgaggaactggcaaggttgacctctgatggccataactattctacatgtcatcttcatccccagcaaagccttatcacagccaccaccaacaactgcagtctaagccactgaagagctcacagacaccaatggcactaattacagctgaagaaataggaagactacactactgctcccacccagaatcaaatccaaagtaccatactcacccaatactatagataaaatctatagataaatgtctttccctatgaaagccagtccttaaaatgggaagaagcgactgtacacaagctgcatacatatcaatctaaggacataaacatgaaaaatcaattaaattgacaattccaagggaacacaataattctccagtgaaaagtcttaatgaaaagaaaatctatgaaatgcatgaaaaagaattcaaaataatcttaaagaaactcagtgagatacaagaaaacagataaaaatataaagaaattagaaaaacaattcatgatttgaatgagaaagttcaacaaagaaatatatctaataaaatagaaccacatcctggaaatgattaatttaattaatggaatttaaaaatacaatcaatagcttcaacaatataatagatcaagcagatgaaacatttctgaacttgaagacaagttgtttttaaataaccccattagaacaaaagaaaaaaaaagaacaagtaaagtctacatgacatataggacaccacaaagtgacaaaatattctaatttggggagtgccaggataaaaagagatgggcaaaggcatataaaacctatttaacaaaataatagcaaatgtaataccaagtgttgcaagagaaacagacatcagacacagaaaactcaagtatccccaaatagattctacccaagaagatcttctccaaggtacaccatagtcaaaatatcaaatttcaaagacaaagaggtaattctaaaaacaacatgagaaaagcatcaaattacatataaggaaacctccatcagacgaatggaggatttctcagcaaaaacattacagagcaggagagaatgggatgatatattcaaagtgctgaaagaaaaacaaacaaaaaaactattagccaagaatactaaacccagcaaagctatttttccaaaatgaagaagaaatgaaggattttccagacaagcaaaaattgaagaaatctatcactgctagactgaccccacaagaaattcttaagtgagccctacatctagaagcaagcagatgatgtccgccatcatgaaaacacacaaaagtaaaatactcattggtagaacaaaaacaagtgagaaagagaaaggactcaaatgttactattacagaaaactaccagctgcaatgaaaacaataagaagggaagaaagaaacaaaaggtacacacaacagccagaaaacaattaacaaaatgagaagaataaatcctcacctataataagcttgagtgtaaaaacattgtttctcacttaaaagatttaaaattgttgaatggataaacacaacatgacacaactatatgctacctacaagatattcacttcacctgtaaagacacatagagactaaaagtgaagagatggaaagatactccacacaaatggaaacctaaagagaacaaaggtagctatacttatatcagataaaacacaattttagtcaaaaaatcttagaagagaaataatgttattatataataataaagggataaacttagcaaaggtataacaattctaattatatatgcacccaacactgaagcactcagatatggaagttgggtactattaaatttaaagggagagacagacttccaataaaatagcagatgggactttaatatcacactatcagcactgaatagatcatatagacagaaaactaataaagtaacactggatttaagctaaacttttgactaaatggacctaatagatatttacagaacatttcatccaacagctgcagaatacacattcttctcattggcaaatgaaacattctccaggacagaacatatgtcaggacacaaaagaagtctcgacaaattttgaaaaatttaaattacatcaagtatcttcttagattacaatggaataaaatttaaatcaataacaagagaaactttgaaaaccatacgagtacacagaaattaaacagtatgctcctgaacaaacactgagtcaatgaagaaatcaagaagggaatacaaaaattcctgaggcaaatgaaaatggaaatgtaacacagcaaacatgtggatacagcaaaagcagtactaagagggaagtttatagcaataactgtctacattaaaaaattagaaagattttaagtaaacaacctaatgatgacttcaaggaactacaaaagcaagaacaaaccaaactcaccattagtagaaggaaagaaataacaaagttgagagcagaactaaacagatagagactaagtaacaatacagaggataaacaaaacaaaagacagaagatctaaataaataaaattagaaatgaagaagagacattacaaatgataccacagaaatacaaagaataactagagactgtgataaataattacacactaacaaattggaaaacccagaggaaatggaaaatttggggcacaaacaacataccagggaataaatagaaaacctgaacaaaccaataatgagaaattagattgaatcagtaataaaaatctctcaacaaagaaaagcccatgactagatgactttaccacaaaattctaccaaacttacaaaatactaacattaattcttctcaaactattgcaaaaaaatgaagatgagggaatgcttcctcactccttctacaataccagcattaccctgatacccaaccagagcaatgacacaagaaagaaaaccacaatccaatatccttgatgaacataaatgcaaaaatcctcaacaaaatactggcaaaccaaatttaacaacacatcaaaaggataacacaacatgatcaaatgggatttatcccagggatgcaaggatggcttaacatttgcaagtcactaaacatgatatatcacatcaacagaatgaaggagaaaacccacatgatcatctaaacagacagaaaaagcatttgataaaattcagtaactcgtcatgataaaaactctcaaaaacttaggcatagaaagaacatacttcaacatagtcaaggccgtgtatgacaaacccacaactaccatcacaaggaaatggggagaagttgaaagactttcctctaagaactagaacaaagcaaaaatgcccacttccagccctctagaattgaacttagtactgaaagtcttaaccagagcaatcaggcaagagaaagaaatagaaggcatcaaaatttgaaaaaaggaagtcagatgttctctgtatacaacattaccctaaatatagaaaaacctacactcaaccaaaaatttcttagaactgataaatgaattcagtaaagttgcagaatgtaattaaaaagtgggcaaaagatctgaattgacatttcttaagagaagacacaaatggctaccaagtatataaaaaatgtgcaacataactaatcatcagggaaatcaaatcaaaaccacaatgagatatcatctcatcctagttagaatggctattgtcagaaagtcaaaaaaaaaataacaactgctggcaagaatgaggagaaaaaaataactcctacatactgttgatggaaatgtaaattaggagagctattagggacaacaatttggagatttctcaaaaaactaaaaataggactaccacacaatccagcaattccactactagatgtatatcaagaggaaaggaaatctgtttatcagtaagatacctactctcccatgtttattgtagcactattcacaagagccaaaatattgaatcaacctgtgtccatcaaaggacaaatggataaagaaattgtggtacatataattaagagaatatcattcagccacaaaaaagaatgaaatcttgtcatgcgcagcaacattatgttaaatgaaatcagccaggcacagaaagacaaatattgcacattcctatttatatgtgaaagctataaaatttatttcaaggaggtagagaacataatcattgttaccagaggcttgaggcagtagggccaggagggagaaggggtgtgaagagtggctgattaatgggtacaaacatacagttagatagaagaaataagttccagtgttcgatagcacagtagggtgactatagttaacaataatttgttgtatatttcaaaatatttagaagagaaaattggaatgttccaaacacaaagaaatgataaatgtttgaggtgatggatatcctaaatagctttatttaaccattacatgttataggcatgtgttaaaatatcacatgtatcccataaatatgtgtaattattctgtatcaataacaaatataaaaaattaattaacaggctgggtgcagtggctcatgcctgtaatcccagcactttgggaggcagtggtgggcagaacacttgatgtcaggagttcgagaccagcctggccaatatggtgaaaccccatctctactgaaaatacaagaattatccaggcatgatgacaggtgcctgtaatcccagctactcagggagctgaggcagaactgcttaaaccccagaggtggaggctgcagtgagcccagattgcaccactgcactccagcctaggtaatagagcgagacctcgactccaagaaaattgattaataaaagagaagctaaattattgatattaatacaagagggactgtcattaaagatcttatagatattaaatggatactaacagagtattgctaacaattcttatgacaaaaaaatctaacaacttagatgaattggacatatttacttaaaaatacagcataccagaagacaaaacacaaaatctgaacaccagtatcaatgaaagaaattaaatctgtgatttaaaaaccttcccataaagaaaactccagacacagatggtttctctaaataacaccaatcctacataaatttcttcagaaaagaaagaattatttttttccctctcagttaaagtgaattgttgtgtcatagggtaggcatatgtttagtttcataacaaaatgccagaacatttcccagagtggttgtactgttttacagcatgtatgtatgagaaaatgctgatttccccaagtctttacttgaagcatggaaagctgtgagaaactcacgctatgcaatgagtgtccaagatctcaggcttcatttgagtattatcattcattcatgtgcctatccataaacccatctatcccttcaacaaacataaagaattttctggtgagaacacaattctaagaataaagtgacaagtagatacagtgttggccttcagaagcttacagtactagtaaagaaaggacacatctataaacaaatgaaacttagaatttcaggtgctattttaaaagttctgtcttcagtggatgtcatgcttttggaatgctaaaggaataacttcacttacaattattagaatttaagagtcagaacaacgttaaaaagtcagcaggaattacagcaaagtcagtaccacagtattttacagaacctctggaaacacctgcatttaccacaccattcacgtagtgatctcggcaccccaaaacacaattaggtgacctgaccatattttcttgtactcacaaggtttgaatgaccttgaaaaccatagagacttcaacattattttaggcaaaggtgtcaatatgagtaaaaggttataaatatgattgatcatcattcatttaaaaacataactaatggcttagaatgagtagatcacaatttgtaaggtgtggtgagaaatggggatggggaagggatgaattcaggaagatattagtgtacttttcttggaggcatggaatttaccatgtgaacaactaagaaccattgaatgtggtggtaaattgaagaagaatattaaaatatttgcattttagaaagattattatttgcattgtggagaacagtttgaagaggtatacaactggcagtaaaatgtatttgattattacaagaatagagaactgatatgtgcatgaacttaaatatctcagtcacagagggctacaggagacagataagagaaaaattaagaatgtataatggaaaagaccggtaataataatattatggtatacagtaataataatagtaatatttctatagaaaagacttatgtaatgctaattgatgctatatgcttatattataaaacaaaatatttattaattacaacataatttaaagtactaagttaacaagctatattgagaaatattaacaaagttatgtgattttgttacatgagtacaataacttatataaaatttattatgtaccagataacttacattattttttctagctgtggagaccagtgtagactggtaccaccaatgagtgagaaaaggtaataactacccaagttccatatttttgtagaattcttactgtgtgccaagtagtgttttgttctatacagttcacaatcattattatttatatttttcacacctacccttagatatgagagaattgggactcaaagacattacataattataccttcaatagattatgcaactagcaaatgaaaaagacagaattctgacccatgattccaaagtcctgtacatgaaggaaagatagtgattgcaagttaaaatatgtgggatagctacatgttatccagagtaaaggccttctattttggacctcagaaagcattacagtatttgggaatatcagcatctgtgtagtcactaaagccatatcaatttgtgacttgctcctcactgtatagacagaatcaatgtcattctattcttaggaaataaaaacaatcattaataaataacaataaataaaaataatcaatctcatgagaggcatatgaaagctctccagagtcagcatgccaatgattcaagttcacctctaacctctccagtagtagaattcagctgagagtcaagaatttcatggtacacaagtttggttttgttgcagagggaagaaaaagggatgatgtcagaagagaaggaagattctgagtatgccatggggtaatatcatttgaaatattttgtgaattctgctctgaaattgatatcaaagctcaaaacaaatgagaatttgttttgaaaattctcatttgttttgagctttattatttcttcctattttaatgggaacactgagaaatccagctgctacctccctggtataggtgctggcaggagatgacagctggtgcagcaaccctggccagaaccagatcccacagtgtactgactgacaatggatccatgcatccattcagtgaggaccggagcatcaaaagagggaacgtggacactgctctgtgactaaaggaccattgattgctgtgggtaggcaagtgtccatgacatcttccaacaggctcagaggaaaatgaggcttagagtctgtatgaacatggcatgaagaacaggagattacttcttcttctcattatcccatgcacctgactgaattcccctgtctgctgtggcatgagaaaacacactactaattgttcattttttctgttaccaagcaatttttctgagctctgcctctccaattctattcagtcattctaaaattcgctccaggaatcttaagcatctagtttaaaatcaggattcctttttatagaggatgtacagtaagttctagatttatagggcaatgttttactagtgtaagccacaagttaatattttcaaaattacattttttgttatattttaatgctcaggatggtctattatctcgctatcctctttgtatttaaaaaataataaaggtaaacatataaatgattagatgttatatatgctcggagaagtatataataaaaagttaaagcctctgcaatccctacctatgagtcgcttaccacaaagggaaccactattaacagttgtttgtgtctaagcccaggaacagcttccatgcctacagctgcattcatatatccattttaaagcatataaataataattctataatcactcttatatatcatacttttcatttaatcatgcatctgaaatgtttaattcaagccaacatatacatatctgtatggttttagcagtgtctgtatcatgtagatgtatgtaatgcacttagtaagtgcctagattatagcaacttaccacaattatatttgatcttacaaagacagctataatcacaacagtgtacttatatcttggtgcattttataatatatttcaactttggtaagtgatacggtttggttccgtatccccacccaaatctcatgttgagttgtaatccccagtgttgggggagggacttgatgggaggtaactggatcatgggggtggatgcccccttgcattctcataatagtcagtgagttctcacaagatctggttatttgaagcagctcttccctcattcactgtctctcctgctgatcatgtgaagatgtgcttgcttcccctttgccttctgtcacgattgtaagtttcctaaggcctccccagccatgctttctatacagcctgcagaaccatgagccaattaaaccattttctttataagttactaagtctcaggtagttctttatagcaatgtgagaatgaactaatagagtaagtattgcagaatttcatcctagaatagatttcaagttccactttcaccaacaatgcatgaaaggcttttgttcttctacagaactgatgttattaacctataaaacttttgtttaaaagtggttggcaagatggccaaataggactccagtctgtagctcccagtgagataaatgcagaaggtgggtgatttctgcatttccaactgaggtacccagttcatctcactgggactggttagacagtgggagcagcccacaaagggtgagccgaagcagggtggggtgtcacctcacccgggaagtgcaaggggtcagggaaatccctcctctagccaagggaagccatgatggactgtgccatgaggaatgatgcattccggcccaaatactaagcttttcccacactctttgcaacctgcagaccaggagattccctcgggtgcctacaccaaaagggccctgggtttcaagcacaaaactgggcagccatttaggcagacactgatctagctgcaggagttttttttcataccccggtggtgcctggaatgccagcaagacagaccattccctcccctggaaagggggctgaagccagggagccaagtggtctagttcagcatatcacaccccagtggagcccagcaagctaagatccactggcttaaagctctcactgccagcacagcagtctgaagtcaacctgggatactcgagtttggtggggggatggggggcatctgccattactgaggcttgagtaggtgggttttcccgtcacagtgtaaacaaagaccctgggaagttcaaactgggcagagcccaccacagctcagcaaagccactgaagctagactgcctctctagattcctcctctctgggcaaggcatctctgaaagaaaggcagcagctgcagtcaggggcttatagctaaaactctcatctccctgggacagagcacctgggggaaggggtggctatgggggcggcttcagcagacttaaacgttcctgcctgccagctctgaagagagcagcagatctcccagcacagcactcgagctctgctaagggaaagactgcctcctcaagtggatctctgaccccagtgcctcctgactgggagacacctcccagcagaagtcaacagacacttcatacagaagagctctggctggtatctggcaggtgcacctctgggacaaagattccagaggaaggaacaagcatcagtctttgctgttctgcagcctctgctggtgatacccaggcaaacagggtctggagtggacccccagcaaactccaacagacctgcagcagagggtcctgactattagaaggaaaactaacaaacagaaaggaacagcatcaacatcaccaaaaaggacatccacacaataaacccatccaaaggtcaccaccatcaaagaccaaaggtagataaatccacaaagatggggaaaaagcagcacaaaaacgctgaaaattccaaaacccagaatgcttcttctcctccaaaggatcacaactcctcgccagcaagggaataaaactggatggagaatgagtttgaggaattgacagaagtaggcttcagaaggtggataataacaaactcctccaagctaaagaagaatgttctaacccaatgcaagatatctaagaaccttgatagaagggtagaggaatggctaattagaataaccagtttagagaagaacataaatgacctgatggagctgaaaaacacagcatgagaacttcgggaagcatacacaagtatgaatagccaaatcaatcaagcagaagaaattatatcagagattgaagatcaacttaatgaaataaagcatgaagataagattagagaaaaaagaatgaaaaggaatgaacagagcctccaagaaacatgggaatgtgtgaaaagaccaaacctacgtttgattggcgtacctgaaagtgacggggagtatggaaccaagatggaaaacactcttcaggatattatccaggagaacttccccaacctagcaagaaaggccaacactcaaattcaggaaatacagagaccaccaccaagatactcctagagaagagcaaccccaatacacataatcgtcagattcaccaatgttgaaatgaaggaaaaaatgttaagggcagcaccacgtcacacttattctaaaatcgaccacataattggaagtaaaacactcctcagcaaatgcaaaagaatggaatttataacaaactccctctcagacaacagtgcaatcaaattagtactcagtattaagaaactcacttaaaaccacacaaccacatggcaactgaacaacctgctcctgaatgactactgggtaaatagcaaaattaaagcagaaataaataagttctttgaaaccaatgaaaacaaagacacaacgtatcagaatctctgggacacaggtaacacagtgtttagagggaaatttatagcactaaatgcccacaggagaaagcaggaaagatctaaaatcgacaccctaacatcgcaatttaaagaactagagaagcaagagcaaacaaattcaaaagctagcagaaggcaagaaataacttagagcagaactgaaggagatagacacatgaaaatcccttcaaaacatcaatgaatccaggagatggtttttcgagaagatcaacaaaatagaccgctggtcagacaaataaagaagaaagtgagaagaatcaaatagacacaacaaaaaatgataaaggggatatcaccagtgatcccacagaaatacaaactgccatcagggaatattataaacacctctactcaaataaagtagaaaatctagaaaaaatggataaattcctggacacatacaccctcccaagactaaaccagtaagaagtcgaatccctgaatagaccaataacaagttgtgaaactgaggcagtaattaacagcataccaaccaaaaaaaggtcaggaccagagggatgcaaagctgaattctacctgaggtacaaaaaggagctagtaccattccttctgaaacaattccaaacaataggaacagagggacttctctgtaattaatttgatgaggccagcattatcctgataccagaacctggcagatacacaacaacaaaagaaaatttcaggccaatacctctaatgaacattgaagcgaaaatcctcaataaaatactggcaaaccaaatccagctgcacatcaaaaagcttgtccaccacgatcaagatggcttcatccgtaggatgcaaggctgattcaacatatacaaatcaacaaacgtaatccatcacataaacagaaccagtgccaaaaaccatatgattatctcaatagatgcacaaaaggccttataaaattcaacaccccttcatgctaaaatctctcaacatactaggtattgatggaacgtatctcaaaataataacagttatttgtgacaaacccacagccaatatcatactgaatggacaaaagctggaagcattcccttggaaaactggcacaagacaaggatgccctctctcaccactcctgttcaacatgttattggaagttctggccagggcaatcaggcaagaaaaagaaataaagggtattcaaataggaagagaagaaatcaaattgtctctgtttgcagatgacatgattgtgtatttagaaaaccccatcatctcagtgcaaaatctccttaagctgataagcaacttcagcaaagtctcaggacacaaaatcaatgtgtaaaaatcacaagcatttctatacagcaataatagacaaacagagagccaaatcatgagtgaactcccattcacaattgctacaaagataataaaataccgagaaatacaacttacaagagatgtgaaggacctcttcaaagagaactacaaaccactgcccacggaaataagaaaggacacaaagaaatggaaaaacattccatgctcatggataggaaaaatcagtatgtgaaaatggccataatgccagaagtaatttatagattcaatgctatccccatcaagctaccaatgactttcatcatggaattagaagaaaagctactttaaatttcacatggaaccaaaaaagagcccatatagccaagacaatcctaagcaaaaagaacaaagctggaggcatcacgctatctgacttcaaactatactacaaggctatagtaaccaaaacagcatcgtactggtaccaaaacagatatatagaccaatggaacagaacagaggcctcagaaataatgccatacatctacaaccatctgatcttcgacaaaccagacaaaaacaagcaaaggggaaaagacaccctatttaataaatggtgttgggaaaactggctagccatatgcagaaaactgaaactgcacccctttcttacaccttacacaaaaatcaactcaagatggatcaaaaacttaaatctaagacctaaaaccgtaaaaaccctagaagaaaacctaggcaataccattcaggacataggcatggacaaacacttcatgactaaaacaccaaaagcaatggcaacaaaagccaaaattgacaaattggatctaattaaactaaagagcttctgcacagcaaagggaactatcatcagagtgaacaggcaacctagataatgggagaaaatttttgccatctatccatctggcaaagggctaatatccagaatctatgaaaacgtcaacaaatttagaagaaaaaaacaaacaaccccatcaaaaattgagcgaaggatatgaacagacacttctcaaaagaagacatttatgcagccaacaaacatatgaaaaaaaacttcatcatcactggtcattagagaaatgcaaatcaaaaccacaatgagataccatctcacaccagctagaatggcaatcattaggacatcaggaaacaacagattctggagattatgtggagaaataggaatgcttttacactgttggtgggagtgtaaattggttcaaccattgtggaagacagtgcggctattcctcaagcatctagaaccagaaataccatttgacccagcaatcccattactggatacatacccaaaggattataaatcattctactataaagaaacatgcacatgtatatttattgcagcactgttcacaatagcaaagacttggaaccaaccaaaatgcccatcagtgatagactggataaagaaaatgtggcacatatacaccatggaatactatgcagccataaaaaaggatgagttcatatcctttgcggggaagtgaatgaagctggaaactatcattctcagcaaactaacaccggaacagaaaaccaaacaccactttcatgtcctttgcagggacacggatgaagctggaaaccattattctcagcaaattaacacaggaacagaaaaccaaacactgcatgttctcactcataagtaggagctgaacaatgagaacacatggacacagggaggggaacatcacacaacagggcctgtcagtgggtggggggttaggggagggatagcattaggagaaatacctaatgtattaggagaaatacctaatgtagatggtgggttgatgggtgcactaaaccaccatggcatgtgtatgcctatgtaacaaacctgcccattctgcaaatgtatcataaattaaagtataacaaaataaaatttaaaaaaggaacaagatcatgtaattagcaggaacatggatggagctggaagccattatcctcagcaaactaatgcaggaacacaaaaacaataccacaagttctcacttataagtgggagctgaatgataagaacatatgggggcaacaacacccactggggcttgctgggtcagtggggagggagagcatcaggaagaatatataatggacactgggcttaatacctaggtgatggattgatatgtgcagccaaccaccaggacacacctatgtaacaaacctgcacattctgcacatgtaccctggaacttaaaataaaagttaagaaaataaataaacaaacaaacaaataaaacgtttgtttacctgattcaaacattgctatgtggtaataaatggcagaaatgtgaggttttcaacattacaaaaattatactacaagacgagtgcatcacatttgttaatttcaaattatgattttgtattttagagattgtgttttccccagtaagatactggggcattttttaaatgagagacaaaaaaatcacttgagatcccttcacaattaaatgaaagaagacaagatttgctcctatcacaaattgtttattttctacatctctcttaacaaataagcatgaaattatataagacccccaactattgaattttctggaaaatcatatatttgtcttggaaaagaaaagtgacatggtcactaaggaaagctcaatgaatttacaaataagtaacacattttattacaccaatgaaaagcttcattgacacaaagcttttatattgattttaggaaataatttgtattgtacattttgacttttcctccagcatattcactggagaaaggaaagtcaaggagagagaagggttgtgggaatgagaagaacagggaaagatctaagagtgaggagaagggagacagagaaagagagaaactcactggtttgaaaatggcctattttcatttccttgtgggattccctctacttattaaaagaagtttctttctgacatagaagcttcatggtgaataatatcagtgtataacatttcttctgaattttgggttgattttgatgaagctgatcccagagtagactgggtccacatttgggggattatcagacgttggtcaacagaaaggaaaacattaaggtaggaatggatgataacagaatatactttaaacagctcagcttcaaagaattctcttccaacatgatcacatataacattaacaaagatttaatcaccactagctttgttttaaactctgaaggatattctagtgttgtgcagagggagcacagacacacatgctacctggtgtctatattaaataatgtttattgggtaaaaacttataagcagagaaatatcagaagacaactaatcccttaaatcacttattattccaaaaagagatgtgctaagttgagcaaagctaggtggtatgctttcccattgagggcgctcctgccctctaaaagcttcacatatttataagaaacaataggaaggaataaagtatgcaactagaaaacaatggaaaccctctagtcagtagcagatatggcgaaggttgcgggaagcttctagggaagggcctccagtactaagcttctagtgtcagcccagctcattctttacaaaactagcccaaagcagctaagcaaggtcttcactaagctctcacaggcagatgggggaatgagcttctggagtcatccaggtttgtctctactctgtgattttgcatattcttacactgaatgaaggccctaacgatataaattttactgctgtttcataatataaacgtgtgccttggatttggatatagtataagtacaactcaactttttgtttatccatttatttcaccgaatatttatttagtattttgaaatctgaactctgctacttttttgtatttatgaccttgagcaaattattgaacttcgctgaacctcagcttgctcattggtaaacgagagataacaattcctatctatttcctgtcaattcctatctataccattatacaatagtattgtttaatgaagaaataaaataagtcatttaaagtacccggtgaagtagctctttctttgttttgtaaggtagaagagaacaggaatttcctaagttggttatcttggatgaggaaggctatttaatactaaaagccttgcttaataaaattcttagttacaaaaggcatcttaaataaacacctctagtatcactttaagttattacttcctagtttttatttccctgtgcacaacctcgttaaaattcataaatcttacagtaggaggttgtttctgaatcacagccccatctcagagacaatgtgaaacaaatggtacaaagcacacttccaaaacaaacccaaatattttgtgtagccaaataaatacaaagcaattaattcttgttgaaggaaacagacccaagctgtacagaaaaagctgcatttgttgtgggtatttaagtactaagtgacagaaagttcataccatgtcagaactggatagtttaaatcattattttattgtggaaagcaagatcattttaaaagtctcaaaataactctttcttttactttcctaaaactaaactcaagcccaaatcaccccgggactttaatttatttgcttgtcgttcttggtaatttttaaaataataaggttaatgttcaagttcagaattagttcagcccatttcaattcatggacacatgttctaagcagaatgtaatgtgtacttagtattggttttagggaaacatgacatcaaattcctctttggatattctacaaagagcttttatttgaaagatagtgttttaagaatgtgtttgacctgaggcatgtctgaaatggaataatagtgacatgtgtcaaaatggtatattctgttacctaaaacatttccccatatctcccactggtaaaataatgatattttggctctgaaaagtaggtccactctggtgggaaaaggcagagtcataagatcatcacttctatattttctaaaatcttaaggtaccagaaaaaaatgccacatttttcccatttgagaactcaagttaaactgtcttgaaagataaaaaataagtgaaaactatatattttttaagatttggggcaaacatttaaaaactttgtattatagacttcaggaaagcacaacagtcaaacccttttatctttgtctctataggacaaaatgattatattttgattagccttccaccacccacgagcataatgggaatgtctgaattttgagctgctcttagaccatttgtcatcgttaggcaagctagtaagcctcagtttctccatctttacaccacagatttgaaatgaggatttaagatatgatcataaataatatgaccgtgacatagaagaacctcagcaaatgctttcactttgtaaaaaaaaattccaaagatggcatttgccctgagccaaacagattattttaaaaagggcaaataactgtgattctcttccccaattcaaatcgtaggttcctgaaatgcactgcaagatccattcagtttagacagttacggtcatctgttcaaatagctggtaattgcccccctttcctcactagttagcctaattggagtaacataatgttaacagattgacctttaaagtccaacactcatgagttcaaattatgactccaccactgaactgtcactcatttataagttacctatgctctctaaggcctagttttctcatctataaaatgagttaagcacctagcacaatgccttgtgtgctgtaagtactcaataaatgttatgttttctccaaagaaataattctttccaaagaaaaagtatcagctaatgtgtggagttaaaaaattcaaaccaaacaccgcatattctcactcataggtgggaactgaacaatgagaacacatggacacaggaaggggaacatcacactctggggactgttgtggggtcgggggaggggggagggatggcactgggagatatacctaatgctagatgacgagttagtaggtgcagcgcaccagcatggcacatgtatacatatgtaactaacctgcacattgtgcacatgtaccctaaaacttaaagtataataataattaaaaaaattcctgcatacagaataaaaaagtatttattacataaaaatcgattaacaaatttgaaaagaaccctcaaaccccctagtttcaaagaaaatatgttttcctctattatcgccgatgttacaacaaaatctaatttcatccttatgacacctagaaatatcagagtaggctactgtatttgtcacagtgaggttctcaagtttgatttctagctgtccgtcaaaatgccacctttaatcttattagttcatgtcactgaaatttgagatgaaccccataagttttattaaaaacagagtagagttgccatccaaagctaatgaataattgaatatatttttcatattagttcataagagtcataaataatgacatataacatctaattagtacatttttagacataaatgtttataagaatgatgtgatgaagtacattgatgaagtacattaaattataattattctttggttaaaagatttgcaatttaacccatatgacatctgtatcttgtaccttttagcttattctctaggtagctatctgtctgccaccaaaataacatatggtagaattaaacagacgtcattacttgtagaagagtcttcacattttgcaaaagtaaagcaactgtctaactcacagaaagttaaaataattctaagcctctctcccccaaaataaggtatgtgccaagtagaatataattctctcagaaaacaatcacctccaggaaatctcaagggaataagtttaataccttgttccaatctctgtacattgcttcagcataagatagcaagaaaattaaaagattggttttgtttacagaagacaccgcctttctttcaatacttttacatgaactcatctcattcttattcatggaagaacacccacacttctatgaatccaaagtaccaaagtcaatagaaatatccacatatccaaaataaggattttttttgtcaaagaggaaagagatgtgctaacagtattccaaacatcaaataactacatttttttaatttaacaatctttctttttctaaaataagtgaaaattcagtctccaaattaaaaaactaaaagcactacttttttcagaacctgctcaaactatccagaaatttagggaatctacacctcttcagatatcaagtgatatccgaatttacccaattaattataattggttaaataaaaagtaaaacaatattacaaaaacatttccaaggacaagtttttggcacatacaattttgacaagtgtttggaaaaactggtgctttcatataccgttggtcagtacataaattggtgtaggtgccttggaggacattttgacagtgtccatccaattagtaacttacaaacctttcaagtctgaatcttttctgtatttattccacaagtgtacatgttcatgtatgccaaaaatgtcagttgccatgtttctttgtaatagcaaaccaccggaagctctaggatgggctgctgccttgtgaaaaatgcatgagtgtaaatttggtggcttaagcagaggtaaatctggttaagctctcagtcaccaaaaggatctcagatgatgatgccccctgatttgggctagaaggcagtgagtcatacttctaacatctggtggaaggaaaaatgaaagtacaaaatgctaaaaataaataagttggtaagtgaattagcatttctttagcactaaaatggttaacaactctgtaaaatgcaagataacaggctaccatgaaaggatatttctatctttccttctcaagcttttatttttacaaatggtgattctaagcacccttcttcctatagatttatagggttttccctcagaaccaagatcatggaaattatcttaacaattaattgcaattaaatttaagagcaatttatctagttcacactaggctggtgcccacttgaatgcaagttcgtcaataaagtgtaacttccatgaaagccagattagctttcattttatattgcatccccagtacccagcacctaaaagacagagcaagtgacatataataggtagtcaaaatatatatttgcagaaaaatcagcagagtatatctaatggagttctccaattgtaaatatttcttaagtgaactccactgctcttcaaaataattttgtgtagcatgaacactggcctgtgttcacattcatatatttgctttaagaactttaaataatttatatagtccactgatttaaagaagtcctagaactactaaaaactgaaagaaccgccgtgaaactggaagtcagttttacatgacaatagtagtatgtgctgtccttctatagactaagtgtattagtctgttcttctgctgctttaaggacatactcgagactaggtaatttataaagcaaagaggtttaattgattcacatttctgcatggttggggaggcctcaggaaacttacaatcatgacagaagacacctcttcacaggatggtacaaaaaagaatgagagccaagcgaaggggaaagcctcttataaaaccatcagctctcatgagaactcactatcagggacaacagcatggggtaaaccaccctaatgattccatcatctccacgagtttccacccttgacacgtggggattattacaattcaaggtgagatttgcatagggacacagagccaaaccatatcactaagatggtggtgtttatggaaaaagcccaagaatattagtaaagaggattttgttatagaaatggctctactgttgattaattttgtaaacttaactttgccctttaatcctaggttttcatatttttatcagtaaaatcatgggagttgggttggggaatctctaaattctagttccacttgctttaaattatttgattctatgatttttgcatatagcaatgtctcaaatcttactaacaatagtggggttgctttacagaaaatatatgcccaggccgggcgtggtggctcacgcctgtaatcccagcactttgggaggccgaggcgggtggatcatgaggtcaggagatcgagaccatcctggctaacacagtgaaaccccgtctctactaaaaatacaaaaaattagccgggagcggtggcgggctcctgtagtcccagctacttgagaggctgaggcaggagaatggcgtgaacccaggaggcggagcttgcagtgagccaagatcgcgccactgcactccagcctgggtgacagagccagacgctgtctcaaaaaaaaaaaaaaaaaagaaaatatatgcccagatagaaactcaccaaaaaggataaatcaatctattgttattctcactcttgttctcttgtgtgagtacttccaaagataactggaaaaaaaaaattggcatatatgttcctctaaatgcaatatctcttccctctccccttatctctcactatttacattttcacagcctttcatttccaattcagaacttgttgctgaatacagcaaagagtaaaaatctcttttttacatggattattcatagatcacttgttaattgagcaatgaaacagatattcacatactgttataccatttattggcataaaaagacaatataaaaagaggttttcaaaatgtgacatttgacccaataattccactgattcacatatacatttatattattttgagattatttcagtattatagaagagttgcataaatatttcaaagaattcctgtatactcttcacctgctatccaaatgctaacattttacggcattgtcattctctcttttttactgtgtctgtttccatagatatgaaagcttttcattggagcataatttaagttagagaaaactggaagaaacctaaataacaagcatcaaggaaatggctccttcaattatggcatatacactgtatggaatattgaagaggaattaaaatgttttcagtgattattgtaaaattgaaggcaagatgcttattaggtaatactaattcaaacagttattaaaattttaaagtgattatgacaaagattatggtataatgtctattaaatattgccaagtgaaaactcagaataacatcagtgacacatataaacagattgatggcaaaaaaaaaaagatgagaagggaacatgcaaaaataaatgtagttatataagtgtgattgactggggttatggataaatattctgttttctaaataatataactttttatggactatcctttaagattttgtggatggcaacctgaagtataaacaaggggaaaatattgagtttgagaaattaatcacaaggctataaagtagaaggcataaattgaaccatatactgtaaacactcatagttcatgggagaaagaagcaaagtggtcatttttcccaaggagaaaataaatagaactcaaaacagagaagagattatttggactgagatttccaaaggaataaagctgacacaggtttatgatgaaagtgcaacaaacagaatgctgaattctgctagatatcagtttaattttttactgtgctacacgatgcaattggattgcttctaacctgatatttcacagagatgtattattccgtgggtattactaacagatatgtgcaatctgactgccagactgaacacagacctgtaaaccaataaaacagatattttcaaagagaatttctgataaccaaaatttaaaggaggagatgaagataataatctcttagcaaagaatgtttcacacatgtgacttttaaaagtttaattacatgttcaacacaaagggaaacatttctgaaagccaggaattctgttgtaaggtgttttggggtataaagaatcgtaatttaacgaataaccctcagaatatcaggtggtatttaaaaatgctttgttttagtatattttctcattaatttttatctgaatatttggctctaaggcttacaaacctatgcataggcaattttgccaggggaaataggcaggaagtattttcatctatctgctgaagatacaactttttaccataaagcagtcataattttgtcttggaacgaaacacaaagaacagtataatgttaatcgtgattaaaaaataatgctatggtgttagaatatattatcaaaaagtaagctggccaatgttcaatgttttgtttctgttttctcataagtgggaaagaaaagagaaatgagggaagagtaggtttggagaaaataaaagcagaaaaagtctgcaatatctcccagtgtccacaccaagctgttctccacttagattagtctaattcattctgtataggtaagatagaaaagcagaaaagaaagtatgtatctttaatctatgattaaaataaattataattgcatgttttcatcttcgccctatcactaattcacctcctctattactagccaaaggctcaagtattttgcaatagtagcacaattataagagcattggtagaaggtccagcgacaagaggttagatttttatatattttattttacatatttatatattttattcattgtttgtagtaaagaaatggaggaataaaaaatgactctcagaatttgggcttaggcatcttgataaacggtgacatgatttactgtgaagtacaaaacatagagagacaggtttggggaaaaacaagtcatctgtcttgaagaattcaggtatgagatgtttattagtcacccaagagaaaataatttagtatcaagtgggcagtattagcaataatacatgatggatttctgatttaaaaaatctttatcagaaaatctagtatacatgtagtagcagaaatcggtctctcagtaaaatttctaggtagatacaaatggaattctttcctaacatgagaccacccaagcaggtttaacacataagaaactggtacttgaaccccagactctactaaatacaatatctttattgtatctaaggtatacttcatggtatattaaatctttgcaaaacgaacattgaaaatctaaagctaatcacaactccagaaagaaactagattattttctttttctaaaagaaaaggatgcttttactctgctcatagctgagtttgtcatctattgttatttcacagatgacataattcacaagttattaaaggtttcactgcagtctgaacttgtattcttacacattccaaaacactttcaattttctttaactaccctctaaagtaatttcagtaccaaagaatagaggaggaaaaaatatacattgaatgtgtaaagcaggggcagagagttgatctattacgacatacatctttatgaaagaaaagataggatgacttgctcatggctacatactttataagttatttcttctcactcataaagatagttcttttttaaaaaggttaggatttctttatattttatacaagttatctctcttcagtcttcacagtttttgtagttgtcaagtttcaaacactaaaggacaacttactttttcacagttatcgtattgccttctcaacatatatgctgctgtttagaatttatccccgagtcatggtaaaatcatagtttaatctttgtgtatacaaaatcatatctgaataaaaataaagtctgtaaaattcaaaatcatatccagatctgatgatagtaaccaatacaaatgggattataattggattgtcaatctcatcaatatcataattattcttttaagttatagagtactaaaattgtagtcatacaaaatgaatgaattctagagttctgctgtgtaacattgtgcctatagttaaaattaatgtattgcatacataaaattttgttgctgggcctggcgactcatgcctataatcccagcactttgggaggccgaggtgggcagattgcttgagctcaggtgtccgagaccagcctgggcaacacggcaaaacctcctctctacaaaaaatacaaaaattagctgggtgtggttgcacatacctgtggtttcagctacttgggaggccgaggtgggaggatggcttgagtccaggaggtcaaggctgtaatgagctgagattgtgccaatgaactccagcctgggttagagacctgtgtcaaaaaaaaaattgttaagaagacagagttcatgttaaatgttcttacaacaataataaataaataaataaataataaatcatatagtactaatttcataaaggtatacatacctatgtaaaaatataaaataatatcaaaagtatatgcttctatgtgtctagaaagaaatcatataaactaagtatataaataagcatatatactaagtggttaactactccttttgtagagtaggaataagagcaatgtttactttttatttaatgcatttctatattgtttgtcttttatagcaggaatgcattgtttaaaaaattggagaaatggcaagttatagaaaggagataactacgtgtagtaaaataacaacaataaataaaatcactaaacatcagagcaaaatcacatttgtcaatttgattcagaaggtttccaaaatgtccaatacaattataagaagataatatggcatatgaagataaaaattaaatgtagttattataataaaacttttgtaaaaataggacagtagtatgccaaacagattactctcaaatttttctatttaatttataaaatagtattaagcctgtaatgtataaaaggattcatggaaaaatcacaattttaaaaataatctggctttcaaagtgtatcttaattaataataaatatcacatcatgtactataacaacctaagtgaacaatactgggattaaggccacaaatttgaccacatcatgactttaaggatgttacagtataactatgttaaaagaaaaacattttactaaattggactattaaatttcctaagaaaaatgttaccttgcctcttaagaaattaaaaagcaacctctgggtcattttcagtaactaagttctaaactgcttctttcattcattcagtaaaaaacatgttgattgactctcatgtatcaaagataaagaagtgaataaagcaaacaaagaaaaactgtcctggtgatgctcacattctagaggatggagaaagaataaacaaaattaataaacaaaattaattttaaaatatttagaatgttagtgataaaggtaagggagaaaaattaagtagagaaagaaatagggattgggggtaattttgagtttaacagacaaactgaggagatattggagtcaagatcagaaagagggctgggcatggtgactcacacctgtaatcccagaactttgggaggccaaggcgggcggatcactcgaggtcagaagtttgagaccagcttggccaacatggtgaaacccatctttactaaaaatacaaaaaaattagctgggcgtggtgcaagcctgtaatcctagctacttgggagggtgaggagggtggattgcttgaacccaagcggtgaaggctgcaatgagcccagattgagccattgcactctagcctgggtgacagagcaagactccacctcagaggaaaaaaaaaaaaaaaaaaaagaggaaaaaaaaaaaaacagagagaggtggaaaaagtcatgtcactgtctgggggaagggatttctaggcataagggcagaaggggcaatgatgcaaaggcctaaggtattgcctgcttttttatgtttaaaaattaaacaggcccattcattggatcaaaatggtagggaagagaagtggtagaagaggaagttagagagattgaggcagatcttataagacctgcaatctcattacaaggactttgcttttatcttgtgcaatatgggaagccaacagagggttttgagcacggaaaaggcacaatttgtcttatgttttaccagcattcctctgactgttgtgttgagagcactctaaagggatgtaaaagtggaaatttagacaacagataggagacaactgcaagaatctagagagagattatggcagcccagagccatgttggcattaaagggtacagaagataacagcagtgccttgcccatatttcctggatcttatagttcagttcatgccatttaacttctaactgccagcatcaacatatctttgcttgaaggctatctgggactggagctaacttgtcccatgcatgcagaagcccaacaatatccactttctccccttggacaagcacccacaccaataacagaccggagttggtatataaataccacagtgttgttatttctgaagtggaatgaagctgacacatgtattttacaagagctccagatttccccagggcaatttaccaccagttgcctattgtggaaacttccttgattatgtacctcttactagctgccttccctttcttgtctcatttccccacttcctactatagtttcctggaatcacatccaaaacagctactggcactcaaatcattcccaggatttgggtctggtagaaattcaacctaagttagaagtgatcttagaaggtattaactgatataatgaaaactacaatggaaacattttggaagccatgaaggtaagaagtttaattctggacatgtaaagttagaggtcctggtagatacccaagtggagatttgattatgcaattagataagtgagtctgtacttcaaggagaagtcttggcttccaacataaattatggtgccaccagtatataaatgtaattcaaaaccacgacactgggtgaggtctccaaggtaatgtctgtagataaaaagacagagttcaagaactgtgctttggctgctccagggttaaaagtctagtgcaagagtcagcaaatcatggcctgtgggccaaagccaaccaatggcctctgtttgtatggtccttaagagtttttgtttgtttgttgttgttttggtcttttttttttttaacttttaaagtgttgtgaaaacaaaaagaagaagaggaagagtaggaggcagcagtggtagcataagcagcaaaggaagaaaactaggggacagaaactctatgaaatccacaatgcctaaaatacttagtattggccctttacaggaagtttgctgacctgtggtatagaggaagaatggaaatcagtgagagagagtgagaaggagtgaacagagtggtaggaggtaaaaaagaaggagaacgtggtacaccagaaaccaaatgaagaaagatgtccaaggagaatatcaactgtatcaaaatatgtagatagcagtattataataaattaattgaataagaaacacggatgtcattaaaaaccttgaaaaacatcatttcattggttgtaaggaaaaaagtaagattacagtgggcttgatgtagaaagcacatttttccagttccagccatgatgggataggttttttcagaccagatcgcctactggaaagatctttaaaaatagaataatagaaatatcatctatttgagaacattggtgatctattaaagcagtagactagcgtatacaagatcctagaaagaagggaaggccagagttgtgatccagatatttggtatctactttctttcaaaatatttgctattatttgaatgtaagaagctgagaaaccgagatgataagaaactgagaaagtagacacagagggtaagaagttcagcaaaattttaggatgcaaagaattagagttctgagctcatcaaaaagaaagtttcctagtaaacatccaaggtttcagttagctttcaaacgtctacatcttagaagctggataatcaaaaaacaaaaccagttctcataaagatttaagccaagcttttaatcagacttatcattgattgaacagaagtgatttggcttcattctaaatgactaccagaagtaaactaaattctttttgaaagcaaaaaaaaaaaaaaaaaaaaaaaaaaaaaacctgaaaacaacttagaattctatttcctgttgaaatatgcttcagaaaatgaaggttaaatatagcattattaggcaaccaaaagctgaaagaattcaaattcagaagaaatgctctaaagaaagctctgcggacagaaaaaaagattctgcttggatgctcagaaatgcagtaacaaaaaggatttaaataataaaaattatgggtaactataagaaaaatttacctataaaacaataataatactatcttgaaacatttgaatatataaatatgtgtgttagtgttattttattaaggatatgtaattataatatgtgcaaaagacaagaagacagtataaaagcagttaaagtgttctatggtggttgcattttctaggaagtagaataagttataatttacattttatttaataacacaaaggtacatgccataatcttcagggcaactactaaaatactaacaaaaattgcaaaggtcaaaatagggaatggaattattaaaacacatactaggtggtacataagatagtaagatggcagacttaaaccctaattaaagaaattatattaagtataatttctttattatagtattaagtagaataaatcataataaaaatttagagactatgtgttttctagcctccaagatgacccccagtgattcacattcttcccacttgcaaactgtacttatccccttccaaggcttctaaaggtctcatctcattacatcatcagctcagagtacagaatcttttcacctaaattgggtcccaatgcagatgaagtagccaaagtacaggttctcttgatatatggacctgtgaaactaaaaagacaagctatctgccctgacacactcaacatataatcgcaggacaggaacagtataactaatgtgttagctttctgttactttataaaaaattaccaaaactttgcttcctaaagtaactgtcttagtcaatgtgtgctgctacaataaaatattatagactgggtggcttataaacaacggaaatttatttcttatagtttaggaggctgagacatccaagatcaaggtgctagcaggtctggtgtttggcgagggcccattttcttatctaaacatggccatctcattgtatcctcacatggtggagagcacagagcaaactctctggagtctcttttataagggcactaattctgtttataagggtttcactcattacctaattatcttccaaagtcctcaccttttaatatcattatattgggacttaagattccaacatatggataaggggggaacagaggcacaaggaatcagtccataacaattacacacacatttattgtttcactttctataggtcagcaattcaggtatgacttaactggtcctctacaaggctgcaatcaagatgttgaccaggcatgaattctcatctggagctcaagtggggaattatccactaccaagctgactaaaatattggcagaattcattttctcacagctatatgacgttgggacttacttgttgctggctagcagcacgaggtcactcttggctcctagaggcttcccacagtccctaccacatggccctttacttaggcagcatataatagcttacatctttaaagccagctagaaaacaagaaagaaccttctagcaatacaaaaatttttaaaggaaatataatcgcagggtaacatcacatacatttgtcatggtctactggatggaagctactcacaggtcctactcacactctaggtgtagaggttacataaggtatgaacatccaggaggtagagatcatgggaccaccttagagtgtttttgctatatatgctatagacatttttgttcaaaaaagagaaaaacggtaggccaagcaagtcactggttcatagcaattccaaatccagctgggaaaatcttggcagttcacttattagggctcatggcctgggaataattccattactttcagctccaccctatgcatattcggttctgcaatcaattgtcatttctttgtcatgagacatgcatacagctgagtggttttcttttccttcttcctgacagtagaattttggactcaaatggaatcatttttatattgtctatttcatactgtctaagtgcctttcagtccaagccagcagcatttatgctgatataattttctcaaaaacctcacaggcatcctactcatgagtgttcacagcattacaaaagagccatgtccacacatctccaagtctgaaacaatattttaaatataaagccaagaaatttcatagacctcattttcatattagacatgggtccatgttctgagttaactggataatcagatgttggattacatggatgtatccatgtgttcacccatagtgctgaactactaccctaaagggtaactggccagaaggattataaaaaaacaagcacttccagttattatatacaagtatggagaaatatcaatagaaatattggacaatgtcttgcatactggcacaatgcaaatttgttcagtttgatttgtagaatcatctattcctagtcatgttcaattgtttatgattggaacgaggccaatcttggtcacaggaggaaagagataactgcataaacagtgctttacaaggtttattatcaatgactttggcatgataatatggtgatgagatttggatcaagatttgaaactgccttagaaaatctagaaggaaaaggtaatcaaaaatgtattgaaatttatcaggtatgaacaagatgatagaataattcacttgagggagcaaagccaattgggaatgaaaattaggtttgcttctgtcaggaatgatctaatatgatcctacctgaggcaggaattctattaatcttttccagttctttgattctaagttctaaaagaaagagaaaccttgggggaaaaaaaaactgtgtatgacttgagatctttcctgctgtctcctgggggcatttagtgctataaatttccctctaaacactgcttcagctgtgtcccagagattctgatacattgtgtctttgttcttattggtttcaaagaacttatttatttccaccttaatttcgttatttacccagtaatcattcaggaacagattgttcagtttccacatagttgtgcagttttgagtgagtttcttaattctgagttctaatttgattgcactgtggtctgagatactgtttgttatgatttctgttcttttgcatttgctaaggagtgttttacttccaattatctggtcaattttagaataagtgtgatgtggtgctgagaagaacgtatattctgttgattcggggtggagagttctgtagatgtctattatgtccacttagtccagaactgagttcaagtcctgaatgtccttaattttctgtctcgttgatgtgtctaatattgacagtggggtgttaaaatcgcccactattattgtatgggagtctaagtgtctttgtaggtctctaagaacttgctttatgaatctgggtgctcctgtattgggtgaatatatatttaagacagttagctcttcttgttgcattgatcccttaaccattacataattcccttctttgtcttttttgatctttgttggtttaaagtctgttttatcagagactaggattgcaacccctgctttttttgcattccatttgcttggtaagtattcctccatccctttattttgagcctatgtgtgtctttgtacatgggtctcctgaatacagcacactgatgggttttgatgctttatccaatttgcctgtgtcttttaattggggcatttagcctgtttacatttaaggttaatattgttatgtgtaaatttgatcctgtcattatgatgctcactggttattctgcccattagttgatgcagtttcttcatagtgccgatggtctttacagtttggtatgtttttgcagtggctggtaccagttgttcctttccatttttagtgcttccttcaggagctattgtaaggccggcctggtggtgacaaaatccctcagcatttgcttgtctgtaaaggattttatttctcctttgcttatgaagcttagtttgactagatatgaaatttggggttgaaaattcttttctttaagaatgttgaatattggcccccactctcttctggcttgtagggtttctgcagagagatccactgttagtctgatgggcttccctttgtgggtaaccagacctttctctttagctggtctcaacattttttcatgcatttcaactttggtgaatctaacgattacatgtcttggggctgctgttctcgaggagcatctttgcggtgttctctatatttcctgaatttgaatgctgatcttgaatgactttacatttgtactgatattaaattttatcaacctgtttcaaatgcacaagtgtttaaaatgtattagtaataattgtgtataactactcaattccttgaaaaacaatgtcttgatacaatagattaacatgatatatataagttaacaatttctaatgaacctatacaaactgctagcctatgaaacctatatctgttcatacatttctaatgtcacaaacttatcagagatggaggaagtgaggaaccatgacctgccaaacatgatcagtgttcagtggtctattttaaatttctgtaaacattttacagtccgtagaaacatttctcttttccaatttattttgtatcaagagggctatcatccagatcagttcagtccagtccagttcaacatgagtattttgagtactctctaatccttggccaggctgtggtgaagactgtaaggagaagagaatggaagctccctgtcctgtcctcaggaaaattccacaccctcagggagcttaaaggaaaaaatgctcaaagcagtatttcccgaaatatgtttttttttaaaaaatctcttttgcttccacttgttgctctccaggaagagtttacttcaaagaagtttggggaacatgatattatttcccatacttggatattcacagttcatattagcatttcaaacactctgagaagtctagtactaaagaaacatgttcaattttgcttaagtcaacatttattaaccagggcacactgttttggtgtgatacttattgatgtactttaaaatactctctgctgctttaaaaaatactttgaaaatgtccaagtttaaatgaaaatacattcagacttttactcaaaacaagcataatttcatgacttatttcatgcttagcatttgaaacacaatttaaaataattaaaatcataaagaaatctaatcataaccttgaataacactattattgtggtgtctcagtctgatacttttgtattcacattaaattgactgctatacttcagaatatcattttatttttattatatccgaatccatacaataacaagttatattgtaatgagactctaatatgtcaaggaatgggacaaggttcacagtatatatacttcaatgtttaagtaaatttgtcatatatgatactataagatcctctaacatctatattaaagtaaaattaattttatgacaactacatattgaccaaaagaaatatgaaacaagataacaatgcataatcaaatgattgctatctttcattttgcttttggatattaactcttagttggaaatataaagatatattgatatctttcatatgtcaatcaaatacccagttacacatgagtataacatcacatccatgtgtaaaaacttgccttgtcaatcaaatatcttgttatacacaggtctgacatcaaatttaagtataataagatataagattgacaactaatgagtcaaatgtgagaaaaatacactgtcctttgtttttccctgtttaaattagacagttcttagtttttcattcactcatcactagtccaatttgtaacgtttcactcttactgcaatgcctgtcataattccattcaattttttgtgccattgtgcttttattgacatgtaaaggcatgtgatctacatatattgatgattatatggtactaattaaaaggtcaaatatcagaggatatatagccatatcaagacaatttctaaaattagaaagtgcttcacagattatcctgaataataacaaaaacaaaaatagaatccccaaagaatatacaaattttgtatttttgacatctatcaataaaacctatagcagttacttatgccaaccaatgccacaaaagttttagatttactctccttatctcccaggatctaaggcactcctgggcctagcaggatgtatccagtggtatttagtgcctcatggcttaaaactgccctagaagtaagacctagcaaaagcaacacctgagtagtcacaccagttaaaacattgtgtcattatgagctactagtgataggtctttcggactatatatttttggacaaagttaagtcagctgggaagagacaaaaactgccccattactttggtcataatacatcaaaatatgtaggtatgtctatacactttcctagggcttgagggcagcccccaaacgtttatctgaagccagaggtattaagttatatcaatccaatgtcatggatatagagctaaatcagggcagtttaattcaaataaaatatattgagctccttcctaaagtaaagcattatgctaggttaaaaaaggtgaaaacaacagttggcaatataacgtccttgactttaaaatgtttattgtagtaggaggtttgggcaagagatgaagtaattcctaaacaaagcaaaaaccttacatttgttttaaagtgggccggcaaatatcatgaaggattaaaggagggaagagtccatatttatggcatatcatgaattaaaacataatttagatacagaaaaaagagaagatcaaagatcacggagtagatcaaatatactgaaatttggagaaacagggagatgttcaacttagagagaagagaagttgaagaagtgagaaagttgcttggcccttttaaagaagctgaatgaagtccgaaagtcatgtaccaagttgattagatattcaataataaagattttttaattggtcagttttagtttgtgttgtttaaggcaaagagaagaatcagaaagaccacctggtaaactattgcactattctcagcaaatcataataaaaatatgttagaacagccaaaagaaactcaagaatagaggtaagaggcattaaagagatgcactgtaatagactcagcaaataactggacatgggcaatggaagaaggagataccagagaccatcccaagtgaattcagtgaataatagaggatggaggtgaaacagaaagctggaaaagccatgtggagagttaagactagaagaaaatggagtgcagaaaacatgactgtacatatgatgaaaggctcacaaaggttaagagacagactggagacagaaaagttggaaagaaagaaaccaaactagaatataagatgggaatagtatcaataaaaaatggaatgaaaaaaaatctcacaatcaactagcatttctctccatctcttgctaaagcaccacaagccataaactaaatagttggcagcagataaaggtagctcccagccccatcaatgggaatcatactcagtcatccgcatcctttcttccctctctctttacattctgaatgcaagcccacagtacgtgaatggcagaaccaatccctcaattcagccatattcattttcctgtggcaagatttttaaacggaaaatggaagttttcaatggaagcacagaataaaaagctaatctctacagcatctgagcatgacacccagactgtattatggtcatgaaagatcttttcacaactgaacaaagatgtgttttctcagcccagccactgtttttgtgacatcttgaggctgcatgtcacaagaatattccttggtaaattctaatcattttctaacagctgtgtgctctaaaaatttttttcaaaggttagtaactaaagaagttttcacttaggtttgatcaacattacattttagcaaagatatatttaaatgtacatattacttattgtggttcatcctgtataaatctttcttcaaactaaattatacttattaggcttcagataaatgcatgacacagtcatgtaggattattctagggctataaatactggaaggggaaaaagagcgagatgtagaaccgaaacttggcagaaagcaacaatctattctgacagatgtgaccttatcaagtttataagtgtcatcattgtcatttatatgttctgtgaaagggatggtctgttattataggatgcttctatttattaattggaaaagcttttgatagatgactagaaaagatactttgtagaaattgggaattaatacacacttgctcacatacatgcacatgcatgcacgcacacacacacacacacacacacacacacacacatccgcaagagtacacatcgaatcttgaaatccaagtgcttaattgccatttggtctacttgagggcatgcaattatcagaatataattctaacttcaagaaactgtttatacaaatgttaaacacatatttttatattttttgcacatgcttttttacactagcttttttatttgaatcaaataatattagtagaaagataaatatatatttgttcttctgatcaaaagcagcaatcttactttttctaaattacttactttaagtaatattaaatgcagatgcatggaagctattttcccaaggctttacaatacattttgtatatccaatgataaagttaatccaatatatgcattttctcaaaaatataattattacatagaatttataagtctggtgaaaaagtacccaaaatcactcccactatttcttattatttttatcttaaaagtgtttcactgttgcaaatcaacgttactcagataaatattttcatttgctgggtagcagaagttctgataatgtccgtaattataacagtatatctgttttgtttgcattagataaaaatcattagcatgtatctatctagcaaaggtatttggggatattatgggatatgcatcaagtggtcttgtcccagatttaattatgggacacttgttatttaacagatactcttctgggtaatgtgggatacatttgtgaacaaaataattaaaaaattttgtcttcatttgaatatgataaaatgccaaggcagaggtggaggatagacatgcattagggattaaacatggttggagaggagcttgggggttccattttaaagacagtggtcagatctgaggccaactttgagattattattgggcaatgacttgaaggtaatgaaggagatagaagaaactgccagtgcataatttctacaatagaaacatgcctggcatagtcaggagacagtagagagtgattaaaggagaatgagggaatgagaaaagagtgagagagaagacagagactgcagtaccagatcctatgggattttgtaggtcactggcttctaactggaaacagaaccattgcagagttttagaataaggtagcaagattttgacttacattttaaaagggtcactccagattgctgtctggagaactgtgctgaagcaagaaggatcattagaaggcagtaactcctggcatgaagtggtggctcttgcctataattccaacaccttgggaggctgaggagggtggatcacctgaggtcaggatatcaagaccagcccggccaacatggtgaaaccccatctctaccaaaaaatacaagaattagctggacgtggtggcagttgcctgtagtcccagctactcagaggctgaggtgggagaatagcttgagcctgggtgtagtgagccaagattgccagcctgggcaacaggagtaagaaaaggcagttaatccagttaaaagaggctagaattagcagaggtgataatcgtgagtttgtggatatattttgatggaaattgctgatgaattgatgggaaatgttgaggaaaagaatgttttaaggatgatgtaaggcttttgtccttgcaccttggaaagatgtcgttgctatttatttccattggggaaatttgctttaagtaattacatgacagaaactagtttaatacataggaaaatgattcttattggaggctattcattgaaataactattgattcaggttcaactaattgagaatatttgatgacccaccagagtaagacaggctgaagacttcctttgtatcatcaataaaactaagatttgcaaagaatattaatactgcttataaatttcaggaagagtggaacataaaactaacttggaaaaaaaccttttttctgttttttagaagtattccttttaacaggaagattttgtatgaatagagagccttaaaggaaggctctgtgaaacctgagcttggcaacacatatttttatgtagctgtgaacagctgctttgcctgagtcagccatgaagctaagctgcctctcacaaagtataacacatacatggcctgactaaattattaaaaaaattcagcctctccagtaatcaaagtcatgtaaatttaataaactgtaagattccatctgacatccatcagattagtaaaaggttgaattgtttaaaacaatgtctgattttcaggttcaagaaaaaccaagtgcatacatttgtcttccctttcagccaaaatcccactgaaattatagttgagatgtatacacagaatatataatggtaataacaagggaagtgagtaccataagcagatagatcttacaaacttccagaagatggattgcaaatgggatcatttttaaaggcatgaccaaacagagatagcagaagctcagaattagtacagagaagtcttcatcaaaggtgaaagccactatttccctcaatgccctcgagaggagtcaccaatgtagtcagcagatttgtagagcaatcatgagctgtagaactaaaatcagtataattggtaacaaggctgtccacagaacagctagaagatacctttgtccacaccatcaccttgcacacatacaaaatgctagcctgatagcatttggcttctcacagaaactagagaactctcgtccaaaaaaatgtgacaatactgggcagacagaggggaagacagaatgtgaataaatttataataaagtcatattatttatttagaaatagtacccatttcatggcatcatctaacctaatgattatcaaattgtattattcacttaaaaagtaggaatcaaaaggactcaaatttaaatgttcataagagtaccagggatctaatttaaaagatatgtctagactcctgaaggtctgatttagaaagtttgcagtgggacctaggaatatgcattttgagctaattcccggtaatgactatagcgtaggtggtggggaacagagtaaaagggaaataaatattagtcaccttttgtgggctctctggtattagcacttgcatcttcatcattctttctttatagaagcccttccttgttcctatatatatattcatctcctacttacacatcaaaatccaactaaaagctgtcacctgcctccattgaaatctctctcctctaaatggctatgcttttttttgttctacttatatacaataacaacagcacactcctttaacatacctacattatatcatgatatatatatatattatatcatgatataatgtaggtatgttatattccatatctccctctcgtgtcttactaatgtgtaacttagccaagtgattggaatatattagtttgaccaatatttatgcataggtaatgggtttattatttttattgaaaaaattaagttaatactttactctttctgtgctttccattgtatcactccactcaggtaaaaagggaaggaaaaggaaataaaacataaaaagtaaattctggaactatgtcacaatttaaaaagacatcattttttaacatctccatgtaccattattttattaatttcaagttaatgagtagagatgttaaaaggtaaatctttggcactcatgaacttgtatcagtccacatgtttttccaaattatctattatgggtagttatgcaggatacatattaactgttctgaaaagtaaattattgtctaagaaagaaaataaacagcaaaagataaatccagcattaagctcactaattagagtttagaaatctatggaaagagcattggtgtcttcaagtacgtataatctgaaaaggcctaaattattagatattttccataatcataataatctcaggtttgaaaaataatgtgttacttttagtcttaaaataaatttactgtttaagttgcaaaagcaaaacacactcatgttaacagagacattaaagactaataaatagaagtgttcatcaatttctccatcctcttccacttactacaattctcttcccaggccacactaccattaataaattatgtgagttacctcagagtaggtttctatacattcacaaaataataatagttatgacatttatgaagtgttagctctatgcagaacacttgactatttgcttcaaatggattatctcattgatgttcttaactaccttgtgagatacagatcatgaatatctctgtttttccagggaaagaaccgatacttagagaagctcactaatttgttcaagggcacgaagctaataactggtgaaacaaatatttaaatcaaagcagaatggctccaactttacatctccatgccataatataactgcaaaacatatatatttaattatatataggaaatacattaagatgttacttttaaacatatatgacttttgtaacatagatgagatccattatatgtatttttctctgagttgtaaggattaaacgagatgtgctatgaaagtacaaagcatggcacatgacatgcagttgccattagtgtcccttttaactaaacacaatcaggcatttgacctgaagttatttctgttcatcacagcacctgtcacatactaggtgctcaatatatatttttttcagctttgttttaatttttagagtcatcaatttacattttaaaagaaacttttcttcttctcacatctatggcaaatagctactgactgtttgtacacatttcctttaaaaaaataaaatccaggatctcaggttctgagatttatccttgaagccaacttaccacagaaaaactatatgatagagaacttaatgataacattaggaaataagaatggatggtaccatggtaatagaattttgatacactttttttagcaaaaaaaaaaataatgaaagcaggaaattgaatgtctatatgttctgtcaggctttattttttttaaaagaagtagatgaagaaaagctgaaaaaattggaaatgaatcaaattgttacttaaaatacagagatggtttccattttttaatacacaaaaatgtgaatttttattttgagacaaagtcttgcttactcacccaggctgcagttcagtggggtaaccttggctcactgcaacctccacctcccgggttcaaatgattctcccacctcagcctcctgagtagctggaactacaagggcgtgccaccatgaccgactaatttttgtattcttagtagagatggggtttagctacgtcagccatggttggtctcaaactcctgacctcggatgacccactcacctcggcctcccaaagtgctgggattacaggtgtgagccaccacaaccagcctcaaaaaaatgtgaaattttgaacaaaataaaataaatattagtttttgagcgtgctttatatttcatccttttccaaacaaattttggtgaaaatactgttttacataggataatttatttaaaatatattaacgtaaaagctgatctgatcaaagctacagcagatggctgatgaaatttataataagaacctacttgccctcttgattcatttctaatggaacccaaagaagtttttggaatacagcacttctattttcaggaggttaaatactttaaatagtaaccactagtataacttgtgggccattatatatttaataaagaatgttttcaagtcactttccagtgattttaaatttatttgcatatattagggggaattcagtttgtcgcaaaatgtggtccatggacaacctacaacaacctataggagaatcacctgcagtggttgtttaaaagtgtcatttcctgggcagatgtagaatatgtcaagtgtgatatgagaatgtgcatttttaataagcattccacttgaagcttatgttcctgaaatttttagaaccattgactcagattttacagtggaattatgttgctagaagcatcaaaatgcattggaaaaaatatgtttaaaaattcagccaaaatttttctaatttttaatgcaaaaataatataaatatggtttttgccagaaatcttcctttgtgaatgaatgacttcagttggacgcctttgtgtatggatagaaaagggcgttaatatacattttgatgcaacatgtcacaactcctcatgtctggataactttgccagcaataacaagtatggccttcctttaagaaattaaatgttagatttttcacacttagttttggtttccataacaggcatcttccttgcacggggcaaattatcaagtattcactggtttgtgtttttctctatgatgagaaattgcagttttgcctttcttactacagaatgtgttaaatcaagtccgatttttttttaagaaacagtatacaaaatgaatttggactgagtctataagcaggaaaggagcccaaattgaatcagaactgaaattatactttgatttagttatatacttctccccagaaaaagtgttccacaaatgggaggaaacaatgcttccaacttaaataggaaataacaaagttttagtattttgatatgtggttcctctgcaggtttcatagaagggcatgtgtactacattaaattactgtattaattgagcacacaccaaacaatatgctagatgatacaaaccatatctcgtagacaaggcgttgtctccattctctaggaattaacagtctgtaagtggagggaaggcatgacacagcttagaatgtaagaaatgctataaaggagacatgtataaaattttgaggatctcagggaaaataaagattatttttaatcaaaaaaaaatttgaaagttttcaaatgaagttgacatttactttcagtcattcgaaaacagagacagagcttcaagcatagggttttaacaacctattgtatcttcttcaacatttttgattgtgttgtagcctccttggtagaacaaaagtgccaggaaacagaaaattgttagatttttaaccaaacctaatagcaaaaatccccatatcaggaaaataaattctactattgtattacccaatcctggggcctcttttcatgtagcaattaccagtaagtagaagaggtgaggtaaagtgatgtatcaacatctagatttttaccctgtctgtgggagatcctataaggtctacagaaaatacacaagctcatatggtcagtaaaatcagtatcatagacaaatacaaccattctcctactacagaatcttctccagaaagccatccagagctcacccaaaggcatggctagttagattatttgctgctcctttctgattactgtttatatacatatagtttaactatatgtatacaatatgaattgctaaaatattatatatataaacctataaacatatatacatatatgttcacatgtgtgtgaacatatacaaacatatatttgtaaacatacaggtttacaaatatatacaggtataggtgtatatatatatatatatatatctgtaaagagacctatgaccagagagtgtttgtgaaactcagcttaaattgtattatctccattatttggtcaaattctagcagcattcctggaacatcaaattcccttgttaatatgaaggtaagcattctgtagtcccctcctacttatcttgtcttcttttctacagtgtctttctgacatacacaccatctccttaattcatcaatttttttcagtcacctattgatataataaagctaagtaacaaatagccataaaatttagtggcatataataatatgcatttatttagctcatgcatttgtgggtcaaatgggtgttggctgatatgggctgggctcagctgagtacctctgctgattttggctaaacttgctcatgcatcttttatccttctcttggaaccaacaggctaaccaggacatgcattgttcatcaaacggcagaagtacatggaagcaagcagaaacttgctaggcttcctaaggctgagccttaaaactgccatagtggcattcttatctcattctgttacaaaatgcaaatcacaaggccaaacacacattcaagaggtgaggccatatacactaccactttagtgagaagagctgtaaaatcagattgcaaagtgcacagatataccccacacatgaattaagcatttaacttgtatacatccttaacaccagtgcttactgctaacctaatagttgtcacaacagcatgtagtgatccaattgcttgtttccccacaaaagacgacgactttcttcggggcaagaaccctgccatattcatcatcacggtaactccagaacctcaaatcaagtatgacatgtagacactaacattttatgatagacagataggagagagggaggcagaggaaggagcaaagaaaaaagatagaccatctcaagtgcaagatgtaactgctgttaagctattaccctacagatataataggattctattttccaacattttaaagtcaggtatcactttttcttcccactttctgacaatataagaaaatccgttattaataatataagaagtgatcagaaatgaacaaatatatacttaaggtattttttcttaatttcctttttgaaaacatagattaaaatactccatcactttgaaaatctatttccaatggtggaaggagctataacagtagtcattgtcagtgttattaggtatgtggtctgccaaagaagagacattttatcacttggcaggtataagaaattacatattgttaagggtcactgatacaattgactttggtgtattcgaaggtcaagatttattgaaagagtaggacacttaggattaagaaatgtggatttctttccaggtcagaccatttgggtaagcttcttaaaattaaacctccttaagcctccaccaaacttcagctgattctatatgggcagattttattactaataatggtaaattgtttgtatttgtagggttttttaaaccaaagaagtcaaattatataatagcagtagcaatcactagataattaatacctaagttttgagcactaacagtgtgcttggcaaagtgctaggagattgacatacattatttttaatccttaaaataacccattgaggaaacatcttttgtccatcctttacagaaaaggaagcagaggcttagagaaattataacatacttaaaccaaataaattccagagccagaatttaaatacagatcactatgattttaaagtttttgggtttcataacttggctattgggaataatgctacaattagtgaacatgggaaagcagatatctctttgagatcctgatttcaattcaattaatatacacccagtagtgagataactggaccatatgatagttctagttttaactctgtgagggatttccatactgtttttccatagtggctgcaccatttacatttcccaacagtgtacaagagtgccctttcctctgcatccttgccaaaatttgttgtcctttgactttttgatagtagctatcctaatgagtgtgaggtgatatctcctgtggctttgagttgcatatccctgatgactagtgatgttaaacacctttcagatatctgttgacgctttttttggcttttttggagaaacatctattcagagtctttattttttaatatgatcatttttgctattgaattggagttccttatacattttgatattaatcctttatccaatgtatggttttcaaatattttctcccatttcataagttgcattttcattttgtggttgattcttttgctgtgcagaagcttttgagtttgatataatcctacatacctatttttacttttgttgcctgtttttctgtttttgttttttttacttttgcttttgacatcatatccaagaatcattgcaaggtcaatgtcaagaagctttttacctattttttttctagaatttttatagtttcaggttttatgcttcagccattaatccattttgagtttatttttgtgtacagtgaaggtccaatttcattcttttgcatatggatattcagtcttaccaaaaacattaccggaaaaaactgttttttccccattgtgtactcttggccccctactaaatcagttaactatatgtgtctgagtttatttctgtgctctctacttacttgcattggtctatgtgtctttttatgccaatatcatactcttgtgatgctttgttatatattttaaaatcagtaagtgtgatacttccagctttgttcttttttctcagaattgctttggctgttcagggtcttctgcagttccatatgcattttagatttgttttttctatttcttttaaaaaatgccactaagaaaatgcccactaatgaatgaatggataaagaaaatgttgtatacacatataacgaaatattattcagactttaaaaaggaaattgtcctatttgtgaaaacatgaatgaattcagaggacgatatgttaagccagacacagaagaacaaaaatactatatgataccactttatgataactctaaaatagagttctagagccaggcatggtagaccatctctctaattctagttactcaagaggctgaggcaggagtattacttgagctcataagctcaaggctgcagttagctatgatcacaccactacaccccagcctaagcaatagagtgggactccatccctaaaaacaaaaaacaaacaaacaaaaaaaaaagagttaaacaatcacagaagagaaagtggactgatggttgctaggagctggggagagtggaaatatgtaggcattagtcaaagggtacaaagtttttgttataccagatgagtaagtactagagagctactatacagcatactgcctatgattaatagtgtattatataattaaagttttgctacgagggtagatcctgtgttcttatcagaaaaaaaaatgatagtaaataaagagggctgcaggaaacttttatagctggtagactgtggtaatagtttcagggatatatacttatctccaaccttatcaggttgtatacattaaatacgtacagctttttgtatgtcactcacacctcaataaagtgatttgaagaataattataaagtttgtgaattttcttgataaaacctgattatattctgcattttaaagcattattacttatttagaaaataaccacctctttaaaaccagtagaacgaagccttgaagtttcatgcaatatgaaagtttccaacttctttcctgctccacaatctgtggatattaagctcacatgtagcttatgatattcaaacaaattaataactgcttcaatgcccaggatttaaagtgagatgtaatagaaaggcaaagtgcactgacaatccaaaattacatattagactacatgtacttcagataatatctaggatctcacattttccatgcatttatttttaaagctctagttatgtttattaggaaaacaagaaaagaacaattacaataaagcagatctggagcatatgatttcattttaaattgcagataaagtaaaccaatggttcatgactgtcatttgtatccaattctgagttcccagatataaaagactgctttttcattctctttcacaatctgttgccttccctccttctttcctgttttatttcctttgggagagtaaataagagcaattatttgatttttattcatttattagccagacaacattttaacgacatttatgaagttttaaataaatgctaaaaataatcacacacaatccattttccccatccctattagagatgaggagaaaatgagataacacaggtagactgaaataaacactaaataattatctctgtaatgaatttttaaagtgcaccgaaaggacagtgtaactgaatgaatatgtcttatcaacacattcaaaaggcatttaaaagtgaactgtgatctttagccactattgcttcagaattgcaaatagcgagattagaaacctagggcagtgaatagcattaaattaggataaagagaaagattggcactacgtttttgtttgtttttagttgaatcagggctgccctagcaagcatttaatttgtgtaaataaacacgttggatgaaaaataggattaattaccatgtaatcaatggtattacaaataccttagcccaatattcaggaatctacacatgaaatccaagttgaaaaggacccagatggtgactaaacaagggtcactttcctacatagtgacagagccctcattagacactattaagacacacaaagaagaaatctaagaagtggcaacaagtacatgacttttttatatgtgttaacttcaatcctaaatacaactttcaattgcacaaattattaggcaaaaattatttctatttagcccacaaagataaagtgtgtatgccgcaaaacaggactttatgtctgtctgacaagttgacatatctcttgaatatcattactctcttggaactttattctatcttccattgtattagcaccccacccccaaaagtggttatcttctgcaaatttgatggtggaaatatttcttcctttatccaagatcctattgaggatattgcatacaatgaatctctgatctaagtatgtagtattgctgcttgtcatgctattgcaccttgttgcttcatctattaatacttcctataattgctacctttatgctggctattaaagaggaacatagtaagcattattcttcttgaatatgagattagaaaatagagtggggctaggcgcagtggctcacgcctgtaatcccagaactttgtgaggccgaagcaggcggatcacgaggtcaggagatcgagaccatcctgactaacacggtgaaactccttctctactaaaaatacaaaaaattagctgggcatggtggcgggcacctgcagtcccagctactcaggaggctgaggcaggagaatggcatgaacccgggaggcagagctggcagtgagctgagatcacgccacttcactccagcctgggtgactgagcaagactccgtctcaaaaaaaaaaaaaaaaaaaaaaaatagagtggaacctggatacaaaaaccattcttaactgggtatgttatggaaataagaatgaacacaataaaagatgaagaaggataagatttgaatgcagaacatgggctatgtaggtatcactcacctgacacaaagaataactttttccttcataaacagaaagtaacgtgatggcagaaactccccaaaacatgaaaatgttctcttaagagattcatttattctccacaactatctgtagaagctgatattatcctcactgaatagatgaggaacataagttaagtgagattagtaaaagttgcccaaggccatgaaactaatgagaagacagaatggggatgcctaaaactaaagcctgtgatctcaacaatgcaaactgcctctcaacctaccacttacattgcccagtaacaagttccttttgatcatatattgtatggctgtattcacatatgaaaatttaaattcaatatagccacactaaattgggaggattgtttcttacactcagattggaaatcacagaagcaaaatggacatcagcattatcacatcctttgagatgtctttaatctccaaattgtattattgtacccctccttcatttattctttatcacagtatatatcacttcatatcaagattatcttctattttgcctttttcatcttaccagactttaggaagctagatatgaatgaagatggtttctagtatatgaacatcactgtataaatgattcttgactgaactagttgaatttgcattattctggcctgcaattttgccagcctttttggacttttcaacatttttagtctgtgacaagctgcaaagtgcatgacgcaccattcagctagcagtgtggtagacacgtactcattggtagcagtggtgagggtagtcatctcttcgttgacactctcaaaaaaaaaaaaaaaaaagaaaaagaaacagctctttctctgtcttcccacagctctcctctcatcccatctcccaccccaaaaaggcaagagaagttagggaacagaagttattccacatactaaggcccccttcaccacacacaaaagggtctttctgtactacgtgaacaagggagaatgggtgtcctgtgcctgcagtcatcaaagaatatctcacataatctctgcaaagtctcttcgaaaaccaggaaagatacagatcctcaaggctcaccgtcacatcacagacagatgtgagatataactaccagcctcctgaaataagttcatcagctcagaaaagaacaaacgagacttgacaacattcttgtcaagagaattgataggaaaggccagggctttgccacatgagtacacactgattgttgctcagggcttagagaatgatgagcaagtagaggctatttgctgggaatgttagccacgaacattcagacaaagaaaaggatgattagaggagaacagttgtgcactcttggatgccactgtacctgagaacaaacttaatcttttctctctgattttttgcagctgatctaaaaggaagaaaaagaaaaaaaaaataaagaaaataaagaggagaaaactgtacattttttttctttaatttgtgataatgtttcaatgccaaagataaatgtgatgaaaatgccaaagaaaagaactgtggaatctacagcattcattgtgtttatatagagattatgcttctggttgttaacagcctccagaaggtaagcaagtgctatatctatgcatttaaaatagaggagagcaggcacagttcccattttttagtatagcaaaatgatttgggggctgaatataacttccttttccatataatacaaactttacaagaagttactctgtaactcagagttcatttttttttctctttcctttcaaaaaatcttcataacaaaaagccacaggcgagcggtttttctatttcactgtaatatttcaacctgacactgtgatgcaattaggatcttagaaaggattagcagagatatattctgctcttgcctttatatgctttaattatggtcacaagttacccccaacttttatgccttctccaccccttactgcacacaccgaaacacgcacatacacattatttcaggcttgagtgtgagtttaggctcgatgcattcagaacaaaatataatatgctctatttctcagggctgaaaatacatcaagtaaagaaacacagaggaaatgcatatatgaataaattattttaaatgactgcatttacaatatttccaatattattacatcaataatgcaccaactgtattcgttaaatgaattatggcacagtcatgcaatgggctactattgaggccattaataatgatgtcttagaagaatatataatgactttcaaagatgttcatgatatattgttggcaaaataaagcagactacaaaacagcacttacagtttattcccaattgtgaaactataaaatacaatcattttactgctagtctcatatgcatctaatagcaaagagaaatatctaacctgaagttctagaaggtatgtgtttttgaaaaatgatcgaaagaaaggatatccacaaaagtgttgtttttttctttcggtagtggaacttttttctagtaaatttagcttagtaaactgcataagtaggtcaacaatgataaactataaattcaggttggctaaatttttccaaaatcagagtttgaagatttttttaaataactttgcaacagataagctattattgaacatttttcgaactaagctgtgttttcattaacagaaatttcttacttgttatatctgccttcaatagtaaagtgataaaatacaaaatctagccaaagtcctattagtcaccatcaatataattgttaaaatagacactcaaaatgcagaacatgtcttaatttggagcaataaaaacagaaaaagaaaatatgaggcaaatgaaaattggtaaaaaatttatctccttttgatcgatttttcaagtttctccttccctgtatatattttaagtgaaactaatttcaaaattacatgaaatacaacatgtaaaggtaaatcatttatggttcataacctatctgtcttcatcttcttttacaggcaggttgaattatcattcactgtgctttccaatgaagataattgtgtaccctggaaaaactagaaataattaacatagctgcagaggaaaattatctgactccaagttttctatttttttttcctttggtaaacttgattctggatttaagttagtactgacgcttatttgccattcagtgggcactagaagccaatgatttaatgatgacaagccatcaaaactgcaaaaatagttaaggctgccatatattgagcctttactctggggtctttattatgcatacatgtatatacacatatatgtatctatgtatatgtgtgtatgcataattttcataataattctgaggtatttttatcccagagtaaagatttaaaggaataaaaacatgaaactgaggcttatcccaatttacccaagatacatcaacaacctatcagcagaagctggatcaagtacaggtttgtcacagaatctgtacactaaatgttgattttatacttcatttctgactagtgttttaaaaacagagaccttgtcagtctgtttatttctccaaagtgtccttcaagtttaattaatgtgtctcccttaatgtgaagatgaagttatatagaaagtgtgattggatatacattcaaattacaataaatacacctaaaactgcaaataagcttgagggtgaccataatgatcattaactaattttgctactaatccatcataactaggttcaaagtaagcacaacagtcccgtcttggaaacggaatatgtgttataaaacaaagtaccaaatgaagacttataattaactgtttaaattgtgtatctttgggaacacatacatttaaggttgatgaaatattattggatctgtttatacttcagaaggaagtgacagagaaaaaaggaaagaagatgagatatagggaacaaacagaaaataggcagaccccatatattattgttttcccgagctcacagtatccacttcattaattttaagtttctgagacatgaccactttgggtttttttaaaattcacgttgtcaaaagtgaaaaataaatcaatgtcgctgtaacaaaacaagtcagaaaatgagaaaaaaaaaatgacatctttcaagatcaactgttccacagagtacagaacaagctggcagtctgcagaagatcatacattaactggcataagcactaagaaaaagaaaaagaaaccaaacctgacattcaatgtatatccaagttaggaggcaaaagaatccgttctccctggggactgatatgttgtgatatctctgtatgcagaaatttcctaaccacatccaaggtcttattttattgtgtctaccacagtaaacattttgtatctctcttgcaagagaacccacagccacaacaagtcacacagaagagtatgaataagaattggagatgtccagaaaagctgaaagtgcaattcactttcgtccatttctggacgctttgcaaaacaattcaatagtggtctttatgaacagggaaaaatgcttagaaactagataaaacttaaggaaaatgactacatataggatttcactcaaaagaccatcatttacttcatccctactacacatatcttgtttgcatttatttgaattttttttttgcttattcaacaaacctgtaccaatcatctacaatatattaaaaattttagtaggcattaaagcactacagatgcaatgataaactaaggttttacctaaagcactcagtcaagtaaaatgttgattcaaaatgttgattagtcttgaaatacaaatgtatctcagaaatctggggccaaaagctactgaatgagagttaaaaataaataaaaagcatgagataggaagcagagaactttggaactggaggtaaagataaaaaataagaagtgagaaacaaaactatttacaggaggatcctagaacagatggaattgattaagaaaaggagcaggtattggaaagtaaagcagggacagctgaacagacatcactgggagatagagaaaaaagatataagaatgagacaaaaaagagagaaggtaagtgaaagagacataatgatgcattaacagagacatgataaatatggtagaacaaatgaggtagaaagaatatgaaataaagaaaaagatgaagaaaaggaaatattgattgggcataagacattttgaaacaaaaaacatcctaccaaaatgttaaactagcaagattatcagctccaatccccaaggtaaactgcagagtattacagagggaaccccactttaggaagaaaataatgaagagctttctggggtacatgaggtaagttagaggaacgggggtagttgtttaattggtttatctgaaatagtggctctaggttggaacaaaggcagaccagcatagctatgggaagataaaatagaggttgttgacattctttcttgcttctactctaccattgtctagggataagtaatacttgttcctacaacagcaattcagatctacactgcaaatatcagcaggagaaggaaaaggtggcttagggtagttcctatgccattctgtctcttcaaatctcagggctggaaattccaatccaaaaaatgtttccttctaattctgctcctatttgatgggctagggattgagccctcccctgagaaatagttctactggataaggcatgcggaaggtggttttccaaggccaggttctcttgtatggctcatttgacacccctcctccaaagttcatctggcccccagtttgacacattgcctaccatagtggacaatgagcccaggagaaaacgggatcacagatctaaaagctaagccatttgagaaaaaaactattttgaaataaaaaatatgaaccgtattaaagcttccatcaaaggctgaaattagaacaggtacatcagaattcaaaacaatctcactaagtgtactcaaactgataaaagattatattaaattaggaaagaaaaaagaacaatgaaatatagttttaaaagaaccaagtggaagcacttggtatgaacaaaattgttaaaatgagaactacaacagataggaaaaatattaatagtaaattaccacagatgagaaacaaattagcaatttgaaaataaaattgtagaactgtccaagaaggaaaaggaaacatgacataaaaaataaagttaaaatataaggaagacagaacaaaagtacaggtttccagaagacaggagttccagagagggaatatataaaagtcaagagaagaaaatatttgaaaaaaataaattctctgtgattaagaaaaagatgaaaaggagatgtaatgggcccatagagtaccagagtttaaaataaactcataactataataaaaagcattgactattaatgacaaaaaatttgcagttaccttaataatttcaagaatgaaagagcagagcatatacataggaatcagaacactgaataagagaaaacaatgggggtaatattttcttgaaaataaataattttgaaccaagaattttatatctggccaaactattactcaaataggagatacagatttaaaaatattctcagccatacaaagcttcaaaattttgccacataaaggcccacaagtaaacagtcttggatatttaagaaaaaagaaaaataaatataaatactgcaggaaatacatgaagtaaaagtgaataaacacctaggtaatgtttgttgtaatttttttttaattgctaataccaagggaaagaaaaacagaaaagatagtgataaaatccccagagtaggtaattatcagcataatgggacagaaaaaaaactaagaaatgtgagagctttctaaaattcttgtctcactagtgggaagttataaatcttaacttttatttaaaagaaaaagatttaaaagaaataaagcgggctaattcctctaaaagttgactagataaggtaaatagatgctcccattgagagccaccagagaacttggagaaaatatgtattttaaatgtcttaaaagatattacagagctcaaaaggcagttagcaaatacagggccaagactcagcagaagaagaaaacacaaaaaggtgaactgggcatttgacaccatttttagcctgggaagcctctgctaacttgggaagagtgtgggtctggaaggctgcgaggcccagcagagccttcaataatttggggcccagatgaccagagactatccagtccagggcccaccaagaaaagtggggtggctaatccatcccatgatttggatttgcaaccaagagaatttaagaaagttctaagagaacctagaaaagtctaagaatgaacccaaatggactggaccacggaaagaccaaagcccagataagtcatttcaactcttacttgaaataaggtaatccctactttcaaacaggactcattgctagtccttcttgtctttagccaaaagcaaactttaaatcatctgatgaaagacaaaattaacctaggcttcaaaacgtctttgcaattttttacatacactatccagcaaacaatacaaataatcgaatgtgtagttagagctcaacatgatcataaaatgagaagaacaaacaaaaatagaaaaacacccagacgggatgctatagagttattagacacagaatcattgaaagaataaatataaaaaaatatagtcagtataaggcaatgttaatgataatctaataataattttgtgattaaagatacagataaccaaaatggacaatcccagaagaagagaaacctgcgcaacaggacaaagttgtgacattctcaagtcctaatatttctgggaaaacagaaaagtaaaaatttatattaagctctaataaagtaagtatgcaggctctaaggtcattgttgaaaaagtaaaatgagtattaatgacaaagaaaattaagaacaattgaaaaaacaaaaataatcagcccaaaagaaaataggaagagagaaaagacagcaaaacagacttgaaacaaataggaaggtaacaagatgacagatataaacacatcatctgtctctctatttcactgggaatcacattatttgtaaacagactaaaaactgcaaacaaaaggataggacaggattctctgacaggatttaagtttttaaaagaaaaggagtgcaacaatttctgcttacaggagaaatgtttaaaatttaaaaatacagaaactctgaaaggaaacctctatataccacacaactatcagtcaatagaaagttcgtagagttacatattacatataatcatatatataaatatatattacatataatagtgtatagtacatatactatatataagtagtctttaaggtaaaatttattactggagatatggagataaagtagaaaacttcacagcatataaaaattctaaacttatttgcacttaataatgtagtcttgcaatacattaagcaaaaattaatataccatgtataaatgtgaaatctaatccagagatacataaaatgagaaatgggaaatgtgtaagtacaaaatcacagtgagagattttaaaacacatttgtcagtaattacatttataagaagaaaaaatcagtagatacaaaatatttgagcaatataacaaacaaaattaacctcattgatgtaaatagaacactgaacgtaacaactacagaatacattttcttttcaagcaagcgcaagtgtaccatttaccaaaattaaccatctgctgggccataaagcacgtctcaacaatattaaaaaaggaaatcatgcatattgtcttctctccacagtgaaagcaaacctagaaatcagcatcaaaagttaactgacaaactctcagctgttcagaagttaagacttgtatttttaaataacctacaggtcaaacaagaaaccacattggaaattagaaaaaaattaactgaataaaaacagaaatgtgatgcatgaaaatttttgagatggaattatagccatagccatgcttaaagaaaaatgtgtaactgtagatgtatatattagtttctggaaaatatcgctaagcaacttaagaaagtttgctgtcattagtttgctaacagattttttaatggcagtattgtcaaatgtcaaaattttccagcctctatatacataatcatatttttttaccattaatctactgatgataataacaggttgcttgatgctgaccatttcctgtattcctggataaacacttgagtggtcaagatgtaacaatttttaatacattgttgtatttgatttgtcaatgccatatttagaatttctcataaatgagactggcttacaatattgctttccctttgtgtattttatttattttaaactttcctttccccagtttgtgattaagttaataatgatctcttaaaatgactttttctgtgctctggaatagttctggagtatttcaatcttttcttttaaaggctgttgtatctttcaggtcatctgagtttggtaacagagatggatgataaatatcaagtgtcattatgtacctaagtctgtttctggattcgctatactgttctattggtctgtttgtatgttcttgggcaggtatttcattgtcttaatatacttacataacaactgtgcattacatctaattaatgcacagttttccaatccatgaatataatataaacatatctttccatttatttacagacttctttgtttttgtataataatgtggagtctcatacatcttttaaaaaacctattcctaagtgttagctatttgtgataatagtagatgataatatctactattttatttctgattctatgtaccagatgtataaaaaaagatttttgaccttatatatagcagtattactaaatttacttgatatttctttctttctttttttttttttttttaattgaaagagagtatcactcttgttgcccaggctgcagtgcaatggcgtaatctcagctcactgcaacctccgcctcccgggttcaagcgattctcctgcctcagcctcccaagtagctgggattacaggtgcctgccaccatgaccagctaattttttctatttttagtagattcagggtttcaccatgttggtcaggctgctctcgaactcctgacctcaggcgatctgcccacctcagccttccaaagttttgggattacaggcatgagtcaccatgcccagccaaattcacttaatatttctaatattttattggattttctatgtataaaaatcacatatcttacaaataaaaatagttttgattctcccatgggtaggcctttctttctcactatctacttacctaacttcctttcacagtctccctctctctacctcttcctctctccctctcaacccacttgctcaggtcttcaagatgctattgaccccttggagggttcataatggacattttatcttgttagtaacctcagaggggaaagtgctcaatattttatattgtgatgttagctgtctgttttttaaaagacttttatcaaattaaaattacttccttctattcctagtttactgagacttttagccatgaataaatattgaattttatccgatgccttttcagcctctattaaaatggccatgttgttttttctcctttattctgttaatgtggtgaattacattggttaattttgcacatcaaacttaacttgtgttcctgtataaaacacaatttgtcatcatgtagtcttctttttcatatctttggatttcattttctaatatttaatgtggaatgtttctacaatcatgggacacaatggacttcaattttttctttaaatttttggaagaattaattagtgaagtcactgagatctgatgatttccgtaagcagaagttttaaattgaaaactctcgattttttacaaatcatattttctttttcttatgtgagtcttaatacatttttttcaaaaattttacttactttgcctaagttgtgaaacttatttttatttacatgatctgaagaaattctaaaagttttaagtctttgaatttaagatttgctttgttgccccatgtaaaatctatttataaaatgttctcattgtaccaaaacaaaacctttcactttgtgatcatttggctagtgctttatatatacaactatgtaaattttgatcattattatttttaagatttccttatttaaatgttctgtaaaatttatttttattcatatgatctgaagaggcccatatttatgagtccttttaattcaatattttcattttaataaaacaactcaggatttatatccaaaggtttaaaaagcttgtttgaaaacttattagaaatgttgaacgtttatactgtatattcatgaatggaatattagatattaatattatgggttttaattaacataggaaacattttataatgggaagtgaatgcaataaatatgtgtgtgtgtatttgtaatgaagtgagaaatggaagtaaaacaaaaaatgtctacaattaccacgtctacaaagagcaccatttcttcctcatatttttctgtattttttgctctggaagtattaaattattatattatatatatataatatggttatatattaatgtactgtttattttctgtcatattaattgtgtatgcatgttactaatttatgttaatatataatttacacatattatataataaatgtgtaatattataatgcaataatataggtgagtgcatatatgttatatatgtatatctcccttactcaatataaagatttatttgtattcaagagctctaaatccatcaaatctttccaaattaacaacactgtcatttaaaaattttgcccttttcaccaacgagcatagaattaggttgtagagagtagccactgtattagtctgttctcgcactgctataaagaactacctgagactggtaatttatgaagaaaagatgtttaattgactcacagctcctcaggctatacaagaagcatcactggggaggcctcaggaaacttacaatcatgtcagagcaaagatgaagcaagaatcttcttcacatggcagagcaggaggaacaggcgaaggaggaagggctacacacttttaaacaaccagatctcatgagaactcactaccacaagaatagcaaggggaaaatcgcccccgtgatccaatcacctcctaccaggtccctccccaaacattggggattacgattcaatgtgcgatttgagtggaaacacagagccaaaccatatcagccacaattcacatacacttagaacattgcaaagacaacattgtatgctcatcgcagtccagcctgatatcctttccaataaaatgactcaagatttatatccagtggtttataaagatcaaaaacattgcttctcccagaaaaatatctcgtaaaagaaatcaggcatttactgcaaagccttcttcctcagaggcactgaagatgatgccttatgcaacaaagctcatctagcagcctcagcaaggagaagcagccttgaaaccacagtaagtagatctgagattctcatgagatttagtcacattccaaactcattagagaaatggaagcatatacagagttataagaaaaaaaattctgtacagaaggtacgaattctttctattctatagtagcatcagaataaattgttttggttcataacgactaaaatataaaataaccaaataattatttccacttaatcattcaaactatgttcagatacatattttcactcttggaagtataaagccatatccaaaggaatattcattattaattttacacctttcttgaaataaatctcagaaatctctatacagctcaaaatcaacatcacaaacttttgttctcttacagcctgtgcacatagcttgacagttcttcagcttccaaatttgcagaaccagcacttcaaaatgagaggtaataaatccaccagagaccctccaagaaaagcccattcctcacccaaagcaaagccaagaaaagtatcatggtgaccccaggagtacacactctagtcaagacagatgtttttctcatagtcctaattttaagagaacaagtatctatttacaataaaaaaaaaaaaataagacatgaagcaaccatccaaataagctcagcaaaaattaggcttgtgttttctttagcctgtactttccagatggccatttcattcattcacctattgtaatgatagggcttaatttaaaacccaatttagaaaggatacactaatatacaataaacagacataccaatgaaacataattatgaaaatatataaagcatatttacaaaggatatactattcaaacactagggaggagacaagtagttggaaaacaaatttgaattcctgcattatagaacatatcaaatggataaaaaatctaattttaaaacatatgaagtattaaagggaaatccagatcattcattttataaatctgaagtgaagaaagcctatctaagcatgacaccatttaatgatagaagaaaagataggtttgactacaccataaacagtctctagaacaaaatcttcatcctaaaaaataaatctaattagtaaattcgctaattaaatattttattagaaatatctttataccaaataatatttgacatgtttcaaaaatatatatcaatatttcaccgttaaaaatatctacataagaaaataatagaaataaaacaggttgaagatgaaatgaattgtgaatgaagtcacaaaaccataccaacagatactaacttaatatggactacatacattgctttgtcctaagctctcttctatttaaacactcccacctgaaatatatttcctactctaaattatctcaaatctctactatgatttaacaggacttaacacttgtaagaggtccaagatgacacacacctaaaaacttatgtctacatccttatgacaaattcaattttggtcaatatggtagcacccttttaaaacatgtttcatatgggttttgatctataatggattctttctaaactaatatctactgggggagagtgagagcatttataatatacttagagaaaaatatcaatattttcaactatatgaggtggaataagaaaaattgctaggatagatcagaataattttcaacgcatatttcaattgcgaataactggacaattctaaaatacttagaagtgccccaaacgttctgggcatttggtttttttctatgtgtatttttataatgaaataatacaaacaaattatataaaaatggggaaaataaggagaaattatatataattccaccacatatacgaaccaatgtcaaacattttatttattttcttccaacattgttctcatttgtatctgcctgggtctaagaattttaacatctactctgcaatcttgtttataatttcctctatgagaaaaaggattttctaagctagcaccagctctatcagagtaatcaccaattctaaatcagaaaaagtccaaggtaatgagattttaccatatcacagagaaaatcttgggcacccaaagtgtaatactcttgtatagtaaatgcctcagagaatgtgtttaacctatgacattggggttaaaatagttaacaaaaaaatgtaattaagacctcctattacatggccctttttttcttcttttgcttcttagcactatttctggctattttttaaagaaacatttcttatcaggcagcttcacagactagcaacttacccagggccaatccaaaaagtaactcttatgttttagattcagtttcttctttctgtttgcctatttttaggtagcatgatatatgaagaatgtaaacctttttaaaatttgtataggctgaaaaatcaaaggtaattatctacaagtcttctgaaacttgtgggcacttaaacagattcagtcatctgtgtacgagatctgcacataactagtagtgacattttacaaatgcaactggtccaaatgttataaaaactgatcgtaaggctgtgttagtaaaatattcaacttagtgtgagagaaatatcatgttttttcccacataaaatatagttatacttctccaatacatgaggaactctatgcaatttctgactgagtaggaaaacgcatatttcttataaaattgctactgttttctacccttccatcataatttcacatgcacacacacatggaaattgtttaaattgaattaatttgcatctatgttttctggaagtttgactccccccaattttactttatttaattaatgtcatagtgttatcaacaaattagatgaaaatttttttctcttaagaataaaataattctaaaacttgctgtcttatcttaaagacataaaccctgattgatttgaaaactcaatcaagtgaacacacaaaagctgaattagaacaccaaggcaggtatacttataccataaccagttatgcaaatcaaagatgtcctcacgaacatctcatattctttattctaatcactgtatatcagactacgcagagaagccctgacagatgctgtaattacatttcacaaggagttgccaggacaaagacatggtacagtatggcaacagcttcacagaagttaatagccctggttccaccactgactatctgtacaagtgatcttgaaatagtccttcaacttttgggctgtgagtctatgaaaagtactaacatgacacagatccagaaactattcaaacaaaatcaaaaaataaaaaaaaaaaaagtgcatcaagggttctgaaaaatgaaaagccctgtgacttcaaatgctttctggataagctttctcaagtagtagtagatggagcggaaattttctgatttgcaagcaacgctcaaaatgaaatggcttgccaatttttttcaggggatgggtggtgggggacatttatcgtcttccgattccaggcagacaagcagatgaaattccttccacagcacttcttatctcgacccaagtgcttctctttattttttctttctttctttatttttctaaaatcacttttacttcaagctttgttttctccaacttgtcctatgaagaaaacaaaggttgaagtaaaagtgattttagaaaaataaaagtggttgaggttccgattctgacctgtgcggaataacagggagaggaggggtgagcacagtacagacagggagtctttccatgatggtccccacctcaggtattttcctgatgtttcagagggttactcttaataagccatcctcacctcaaaaaaaagaaacaaaaaaacgacggtgtgaagtagtcagttcttcactgcagaattattcatgacaaaaatggaaaaaccaacaatccaattttctgttcttcattcactgagattcagtgggcagtagtgtttcgcagaaagtacttcagaaaatatgaagataatttcctcatattccataccatcaattagtttctatttcaaaatggattttcctgccctccaaaaaaagtcagttctcatttactttaatctctttatagttgtccttcctctttagctagaaagtatttccttgatgttaggtatctgccaacttggacagctaaagaccaaagctggcagagatacatcattgtcatctctatgtttcattttcccagaacccagcatggggaaaaaaataaaaaataaaaacctattttcacatgcaactgacactagctcagttgctgagattagctcgtgagtgtgggggaaacgtgtaccagttccctttcatatatgtatcctttttatcctcttccatctgcaactcaatggatagaaaatgtgatgggttggagaaatctgttcattctggtaaaactgtctggaggtgtcaaggctaagaatagtcataggctgacattaaatagtagggacacatgctgagctggctcacccaaagctggtgtctacagcagcacgctaaattagaattcagatgggagacattttttagaatattcttgggtctgattactcaaggacatttcaatttagagatgcaatgtggcccctgggggtatgaattcccatgagccaggctgattcaggtgctcttaagaattatctttaaaccagaacacagaatagacaactatcataataaccttcttcctatcattcagtaagggtattctctctgaacacagaggcaggatgcacacagggcaagcaggttaagcaataaagcaaatctaaaagaaactataatgctttctgaggttatggaacaattctgtcctttgaagatttccagcttgcagatttgtctctctgagagcttagctgattcaaatcttggcaacatccaaattcagcctagattgaatatatgtctaaatctgtgacaccataaatgtcacaattatggcaaaaatatccatttcctttggaaaccatgtttcacttccagtcattgctcctttaaatgaattgcacatgtttagacttagatgccccagtggttaaactgatagatataaaaaaggacaggtcactctttcagtcctatttgagaaacaatttgtagatataaccgttcttctactctgaagtttttttctgagttctctattaaaaagagatctttcctatgccttcactttttaccaaactgctatttaagtctgttttctttcacaaactaccaaacaagtttcttcaaagagatgtgttaattcacatacttgtggggcaaggagccttaggcttgagagctcatgtggcattcaagtacataaccctgcctccaggcaggaccctgccaaaaacctatcaaaagaatggaaagtgcaacccgccttctagagctggaggaaagaaattttcagtgattccaatgtttagacaccccatgttgctatctacatgcctaaaagggattcctcccatcttgttatttaaaactcttacttcacatttttttcaccatagagtggaaacacatttgctaataaacctctgatagtcacgctatttcatagatgtgacttcaaacaatccctattcctttagttccccccttataagctcgcatattattcagtcgacatcactgctttgtgcccttatattgctatggcaagaactagaaaaaatacattcttgtaagcaaataaacgacattctgggctcatccactcattcaacaaacattcactgaaagctcctaggagttggagtagttccaggaactgaaattaaagcagtacacaaaacagataaaatccctacccttttgaaatgcacagtcaatctagtgagggaagatagaccatcaacaaagtatgcagtaaaagaaaataaatacaaatatagatagatggatgtttttaaaattgaaggcaaagtcaatagaagtacacatttaggagacaaaattagtagtttgggtttagaaatatggtttgagaagccttttgggtatttccattagatttttcaagtaggcagttggatataagtttgcagacttgggaggagatatctgcctaagagatataaattttggagttaccagatgactcaattttcacttatgattaacttgttcataccatatattttgcaacaaggctccagtcatttgcatttcaacctatcttctttctccctacttctttaactttcagctgaagcacctgcttcattttctcaattgtttttcaaattttctaatacaacttgatacatatatacctgactatatttaatcactaagcttaaggggaaaatttaccttcttctcccagttcgtatttttaccaaaaactatcaagtgttgactttgtgccttgaattgtgttaagcatttcctatgtaacatgtcacttaattatccaaaacccttacaaaataggtattactatgatctacattctgttgatatataaatttaaaaacagagacattaagcaagttgtctcaggtgaaacagccactgtcgtaaacataatggtatatcagatgcacagcccggcaataagtgaacatgttacccaacaccaggcaatttcaatctttgagatatatatatgtgtgtgtgtatatatatatatatatatacacacacacatatatcataaattttatgtatataataaaatgaaaataaacattttattatatttatgtatatatgtatatatttacatacatatgtatttttgtatatatttacatacttattatatgtacataaatatgtatataatgtatgtatatacatgtataatgtatataaatatgtatataacgtatgtatatacatgcataatgtatatgaatatgtatataagtataagcatgtatataagtgtatacatatacatatatgtatataatatgtatatatttgtatacataaatttatataaatacatatatatatttttccagtctactaaaatccattgagagccctttgaatgtgatacaaacatctaaaaactgtgttcaagataagcaggcatattaaagatgagtgccatattctctccaccatgataagttgttatactataaaataactgtgggcctttttagtattctactggaagaatctaaaacttaagggcaaataactacaaagattaaaatgctttttcccaattctgtcataaacttgtaattagatagcatcacttctctaagaatgataaaaaatagttatcacatatttaaaaagtaagatatatagtcaactaaaaagaaatctaaaatgaagagcaattaagtgtttcacccaaggttgtacataaaattaagggagtttaaataaacacaggtgttttgcctgaaatcctttttttctatgctgctgtgtgtgtgtgtgtgtgtgtgtgtgtgtgctatttaacttagattgtgcaatgagacagaacactatgagaactaaattagccttaccctctcaaagtcaacattatcctttctgttccttgcctatttcagccctgaaagaagcctgaaaaacaaggtttttctaaaattgattaatttgtgaaacttctaccatataacaaaattatttggagcatgaagtaactgtttcttcttccattatatcttacatattttttcataaaataaatgcacatattatgcaattcccctaaattattataatgtttagaatttctcgatcactaggctcttcactgtgaggacaacttcctggaagatttacatataaggaggtcattttgaaatgtcagtagctaatccctttggatgatttctaagacataccagccttatgatgaattttgctctgtcatgaatagactctcagaatatagcaaggttgggtgtaatatatccccatttcaagatatggaaacagacgaactgagacttaactttcacatgataactaggaccaaaaaattcttcttcaagctgtgagaagtctgaaaggaaattgattgtgggaataaagtgtattctagagaaataatgttatgaatgtagcctacaataatttatgagtgatttataatttcaagtgtttttgttacatattctaatatttggtcctgagaataacctgatgatgtagggaagtgagatattattaggttcaaactacagatgaggagactgaagctaaaagagatctttcctatgccttcactttttaccaaactgctatttaagtctgttttctttcacaaactatcaaacaagtttcttcaaagagatgtgttaattcacatacttgtggggcaaggagccttaggcttgtgagctcatgggcattcaagtacataaccctgcctccaggcaggaccctgccaaaagaatactcttggtcccctaagaagcaggccacaagataggattaaaacttcaagagatttattggcagagggaaaaggagaagtggggagagacttcagaatgcaatacaagtatgacagttatggaaagagagaatgaaggaaagaggcttgagtaggtatttcttgcaatagtgactacagcacagttgcaagaaagtttcagccagatgatataatgtcctcaagctaaataacttcattggaagagcaagtccaccatctttctggaatgggtccaccttaatacccccaccatgcttagtcattggctgagagcagccaataggaagaataacctctaagtgaacacagtggtgaacccagagggcacacgcggggaatgtcaattacttcctcacatcaggagatcttgagcagcacattttcataactgccacagtctcttctgattaccaaaataataagtaaaaatggtaggcccaaaagttcactgacatctagcagaatattttataagcctttaatgtgaatgacacatgatacttaatattttttggcaactagatttgtgatcattgaatacagttatatgcaacaatttgttagattctacttttgaagccaaatctataatatttatgcatagaagcacaaagttgtagagtgaatctgctaatattattcagctgcatggaaactggtacaagaggggggaaaaatcaactcctgaaatgtttgaaaaactatcaatggattagttttgctactagatgcctctcagtacatactgtgatacaaatatttttaaggttcactaggtgaaattttgatagatgcgtaacattctacagcctatttactttcacctgtctgtctaagtgaacatacctaaataaattatttaaaatcaaaacctcattcctcacaagaaatagtagacatagttatcaagtattatctgtttaatgcattgcaagaaaactttcattttcccctaaaaccgactctagaaataaatcattccttcaaagcacatatgaaaaaactgaggtcaagagactttaacaacttgcttaagatctaacagagaatggtaatttctggatttgaatttggctccattgcctatcaagaaaaggtgcaacacatctaataaaaatagagattatactatggctttacacacacccatttgattgtttaaacaatagtccctagacttgattgatacaaagattcttttaaaagtggaccatcaagaagtgatatattagaagtgatacatttagaagtgatacattaccatattatctttgtaacaaagaagaatcatttttcctatttcttacctatccctgtttctgattaaatagcgtggtaagaatttctctgagaattacggatgaaaaagtatcctatcaattatatttttgtttggaccatttcttgggaaattccagaataaaaatcatataattttttaatctaatgaaataaaaaatttctctatgcacaaacatgtagaaagttcagccaaaaaaaaaaaaaatcaaacgtaatcatgcagttattctaccatgacacaatatccatatcattgtatgtacttgttttctgtgcctaaaacactcttttccatacctctgccatcgaaataagtccttaagactaggttcaaattttccatttttttccctgtgaagccttctgcactatcccccagcctacccttccttagcacatctcaaatgttgcttgaccctgtgcagtaccccagctccttgtatggtacccccaatgtagctgtcatcacactgcagtgcacatatttatttgactgccatcagcgattgccaaagaattcctctatgtttggtgcctgacaaatgtctgtggtataaaagcaaggcgacatggtggaaagcagatgacgcagtgaaatcaactactgatcttaaaaattctaataaagtgatgcctatttatatctaaacttcatatttcctcctccaagtgtaatcatatgatttgataaggaaaaagtgatgttgatgttttgttcagatttatgttgatgtaaccatcaaaagcaaacaatagagcataatatcacaattacattatattctcaggatgatattcaaaataaatagctggatggataaagtacgcaaaaagtgtattagtatatttataataattagcctaaagaattatgccaaataattaccaaaattttgaaaaatattgactgatattttatgtgaacagaaacatagcaaatgacatactgaacataacttcagtgttaaataagctttcctctttgcactaatcttaaaattctgttgtcttaatgtgtccaaacacagtatactatttcaatttcatctactaaacaaaattgaccaactgcattataactcttctgtaaattgtaatacagtgttattaattttatggacttgcaatagaacaatataatcttgtttcatctggtttagtattgtacagtttatgcatcagtatcttttatcagactataaacctcttgaccttagccctccttataatgtccccaaaaggtagcccaatatcttctacataacagacataaatacatacttatcaaattcaattataacataaaaattgaaacagaaaataaatatcttgaaagcaaatgaagaaaaatcaatttgctggttcctttatgacaactgtaatgctactattatgtcttaatatagtcatacaatggtttcatcatttctgtccatcaccaaaaagcattcatttatagagcattaagcttgtctgagtattatatgttatacaactagagacattgtagacaaaattgctgtgtcctgcattcgaataatatcctcgcagaagaacaaagcaacctggtcactaggaaaaatcaaatcacaaatatttctgggaatgaaaagagggaaaattatttatattaatacatgaaaaaacataactcaatgcagttgtaagtttatatattccaaatgtgtttgtatggagaacagattgtcatatggttaaaaaaaactagattgctacatattaggaaaaaaatgcagagatggataaggcaaatctacccatcgttatttatctatgtaaactcctacgtgccatttcatctctcagatccattccccttttccatggaggcctagagcacagactatttatatgaaataaatagaataatgtgtatgaaactcatgtgaactctaaacctgaatacacataagctattattatatcatgtttataaatcccacacaaatgcataaacatacagtatttatagagaattaaaacattcattgtaggactatgtgcattccacaagtagcaccatgtaccaacagattgctgtcacattgcatttgtatctgtaagcgttagtgccattttcgcatacctgttaagcaatcttccgttattactttgcaacacatcatttatgtttctctctttactaacataagaccattatcttgccattcagcaacgacaggtgattcatcctagattccaaatgacatcttcttgacacagggtgttaaaaaaaaaaaaaaaaaaaacttttttttttggacatattttacctgtgctttagattcctttccaaacaaaaactcacaaaatatatttggtagcacaaaccagcagggactcattaaatcctttcaaagggtaaaagacaataacatttcatcatcaattacttgtatattttaccactggagatttctacatgaaaagtccaaaatggtagaagcttggcataaaggagagaggagaggcaaggaatggaaaaacttcataaacttaatcaaacaaaataaacttctgacttgttttttcagttgtcatcaggaaggattagaatgtcaaaaaggcaaaaagtatttttatgcagtgtgacggttaatactgactgtcaacttgtttggattaaaggatgccaaggattgatccaggttgtgtctatgagggtgtcgccaaaggaggttaacatttgagtcagtgggctggagaagacagacccacccttaatctggtggtcacaatctaatcagctgccagcaaatataaagcaggcagaaaaatgtgaaaaggtgagactagccgagccacccagcctacacctttctcctgtgctggatgcttactgccctcaaacatcagactccaagttcttcagttttgagactcagaccagctctccttgctcttcagcttgctgtgggatgttatgattgtataagttaatacttaataaactcatatatatatatatatatcctgttatttctgtccctctgggaaaccctgactaatacatcagcaactgatattagtgctcttactttctgtctcatatcaagacttaagtgaattttttacttctaatttgacattaatattttattatcaattataactaactggtattgaatacttactatgtattaaccattatatcatctcatttaatcatgaaaacaaccttatacagcaagtagaagtaggtaagcaaatcttaggtcatatagagaattacaaaagactgtagatttgaatgtaaatgcatttgaatccaaagcatctgcttttcatagccacttcatttggtttgttaaaacaaaatgaaaacattaagtcaaacaaaggctggaaattaacacatagggaatcaattatcaaatctcctttattgaagcctttcttggggaaggggcacctgttaatgccattcctttgtaaaagtttacctaataaatattcttaaacttggtgtatgcaaagtcactaattataaggatatctatgtgtggagaaagacacaaatgtgaacaaatacgatacaagactgatttgagcacaaagatggctcaactgcctgatgaaactaaggagagatttgacttaaaaatataatacagaaaagagttttgaagggaaggtttccagagacatgaattaggaagggaagttttgacagagcagaagacatttaagggagaaggaacggttcacattaaaaggactggaggtgtgagaaatcagagtgcatgtaaagagcagaacatgaaggtcccacaaaaggaaatacatggacatgggatttaaaagacatatagagctaaatcatggtcctgtgtgtcatgcaaaatatttggaatttaggttttaggaagaaatggagctattgaaggattttcaatcaggcgatgaatgaaacagacttgcatttgagatacattatttagcccttagtctaaaagtagatttaatgggattaaagctgcagacagagaggcaaggaggccaaagttgcccaaagcagattagattttaaaaatggataaattattaaacgtctgagagatctaaaataaaggcttttattttgttttatattagcttcttagcctatgaaggataattttctaaccaattattgccttgccaccttgttattgaaattttatttctaatgccaaaatgacaatgatttcaggtacaaactcatactcatgttgttctttttaccaattaataagataaaaatcttctttgctattataacttacagctgaaaaacatgtttcatagaataaggctttaatttcctatgctatttaataaaagaatacttagatttgatatcctgagaatactgcaatagagagacactatgtactatttttactgttgagggcaaatacaataataaagattattatttttttctgagtcggtgtctcactctgttgcccagattggagtgcagtggcatgatttcggctcactgcaacctccacctcctgggttcaagtgattctcctgcctcagcctcctgagtagctgggattacaggagcctgccatcatgccctactaatttttgcatttttagtaaagacagggtttctccatgaatttttaaataatgagtttgtgcccactgaaaaccaattcagaaataggaatataaaaaattttacgggtgtttaaatgagaaagaatactaagaaaatttgactatcatgtagtagaaaatacaataagtgtaaaacctcaaaagaagtggtatggtagcaccaactgtacaattcctgtcatcatatgtactaagtagaaggttatcagtagatatacaattaaaaaactttttattacatcttgatagtaatggattttgtgatacacccatcaaattgatagatccctcaaaataattgtttgatgactaaaatatcattagtacttcaaatgataatgacaatacagaccattctgtaaatactggtttattacatttagagtcagaaggatttcgtggacaataaataaaacatgaaacttgattttttttaacgttaagttcttggatatatatgcaaaatgtgcaggtttgttacataggtatacacatgccatggtggcttgctgttcccatcaatccgtcatctacattaggtatttctcctaatgctatccctcccctagtcccctacccaccgacaggccccggtgtgtgatgttcccctccccgtgtccttgtgttctcattgttcaactcccatttatgagtgagaacatgtggtgtttggttttctgtttctgtgttagtttgctgagaatgatggtttccagcttcatccatgtccctgcaaaggacatgaactcatccttttctacggctgcatagtattccatggagtatatgtgccacattttctttatccaatctatcactgatgggcatttgggttggttccaagtctttgctattgtgaatagcacaataaacatacgtgtgcatgtgtctttatagtagaatgacttataatcctttcagtatataatgggattgctgggtcaaatggtatttctagttctagatccttgaggaatcaccacactgtcttccacaatggttgaactaatttacgctcccaccaatggtgtaaatctaacttgagttcctatgttccctatgcgggaaaaaagaaatcgttaacagtaaataatgttgtcttaaatgctattattttgctattttgtttgcatttaatttctaaatttattttggggcctaattagaaaatataagcactaggaatttatgcctaatgttatgtaatgtgatgataaaaataatattaaataaacactggggactttctggctattctttcctacaaaaggacacatatattgttgatgtttaagatacatggacttgcatgaggaatgatgagtgtttaaactaagatacttagggaagttttgggaatactcctgtattattacttagaatattggatagattcattcatttattctagcaaatatatctctcattggccacccatagttcatcagctaatattttcaagagtgatctcttgaaacagtgatcaagagtgatcacaaagtggatcttagccagtgttgctccagatttgtattcctaggttgcttttgaaaccccaagttattttaagctcaagggaatatttttatcattttcctctatatcagtgaaaaacttacctaccagtcactatctcctttaagatattaaaaatacaaaaggtagatggcctacaacagccttcaggtaagttgaaatatttaccaagcctaacactttctccaatcttgaatcatctaggaaggtatacaggtaggcaagcacagaaaatcacagttctttcttattcactgagcaaaaatgagaattctgcttagataaacaaatgcttgtctcaaaaattgatttagaagtgtatgagggaacttcaaatagttcatgaaaaatggaaataaaaaatataaactttatttctcaacataagcttcatgatagtcaagacacatttttgagtgatgatatcagccatttggtccatcctaaaataactaagagtttaaccattttaatgacattttgaatgttattatctgaaaaatgtctagtgccctctgtagattttttaagattaagaaaccaaaggaggcagaaatagccaaattaggactgtaaggtagctgtctaatgacttcccataaaaactctcacaaaatcgcccttaattaatgagaggactgaccaggagaattgtcctggtggagtctttggtgaagccttcccaggcatttttctactaaatctttggctaactttctcaaaacactctcataataagcagatgttatcattctttggccttccataaagtcaacaaccagaatgccttgagcatgccaataactagtatcatgacctttgctcttgactggtacacttttgctttgactagaccatgccatctcttagtagtcattgctttgatcatgttttgtcttcaggatcatactggtaaagccatattatatctcctattatgattatttgaagagatgcttcaggatcttgatcccacttgaaatctccattgagagctccactcttgtctgctgattttggagcaatggttttggcaccatagagtagaaaggttgctcaactttaatttttcagtcagaattgtataagctgaacccgttgagatgtctttggtgttggctatcactaatcattcatcctcttcaattagggcatgaacaagataaatttttccttgcaagtttatgtggatgatgtgctgctgcaagcttcatcttcaacttcgtttcaccctttctgaaattgagttattgtaaactgctgatttctctagggcattgtccctaaaaagcatcagtgatttcatcattcttctacccaagcttcaccaaaatttgatgtttgttcttgtgtcaattttagcagaattcatgttgttttgataggggctcttttcaaactgatgtcttatctttcttggtgccttaaactaagttctgttcagacatgtgacaacaaattcatactagtttttttttttggtgcaaaaaaaagttgtgaattccatgcataattttttcaggatatgcattttcaatgaaatttttaaaggcctctcatgtgctaatattgaacttatgtcatggttatattaaaaatgtattgccaaatagaatattaaattattcgggtacaaattatttgctttttcattttactaaataatgtgtgctttgataagcatttctaattgtaagaaaggaaaaaagaagagagtgaggaattaataaaaagaaaaaaggtagagaaaaaggaaaggaaacaggagaaagaaggaagaggaggagggagaagagagagaatgccacatatcaggaaggggggacattcttaaagctagacataaacatggtataaaactgtaataatataaaatccccatcttcatttttgaactggcagaagaaagataagggcagtgatgtgcttcaagttatcgacttgagacatttttttggagctcttagtcaaacttatcccagttacttcatttgttacttgctcttgacatctctgttttcagttttttaatgataaaaattggacattaaaaaaaatcgaactcacaggaagctgagaggattaagagagttaatgtacctaaaacaactcaaacaacacctgccctagatgtggtgagtactaaatttgtgcttatcattaccattatatgattcattgagcacccactgtgaacaagtacaccatcccggtgactgagctcagtttactagaaaactggcaatcaatgctgctaccctccagggacaagacacactgctttggaaccaacagtgtgatgaaacattttatagggtagctccagttgaactaattatcacccacacccatctgtgccatttggttccctgccaaaattgtatgtgttctggtgcaaatatgggcatatttgttcatagatttgctctcacgtggttgttcccaggggcttatctgaagagtaacagcatcagaatctcctgggaaacttctgaaaaatataaattcctaggttccatccccaatgaatatagatcttgagtctttgaagattgcacaaaaatgctatctgtatgtatatagctcatccttagacacagagaatgcagcataatggagaacattccaatctacttgctgaagaatacgcaaaacagacttgagcattattcagttagaaaagaaaagactctgtatcattgtatgattcgcagggcactgcctgacccaagtatcaagtgatagcaactgtttgtaaaagctctccagccagacagactgggttgacatttgcccctccactcagcagctgtgtggtactgggcaagttatgtaagctctctatgcctctgactcctcatatgtaagacagttattataatcacaggttatctcattggttgttgaaacaattaaggggaaaaatgtaaaatacttgaaacattatctggcatgcaggatataaccaataaatgttggttattcttgttaatatcaggtattatatagtctaaatccacaacatataatgaatgaatgcttgagtattaaggtatcccattctattctacttactttctcagtaattcattaaattagaagtccttttttgcagctgttccttaaagtaagtttttcaaaaaagttaatggaaaataacatttcagtagatcaggaagaaatctttttgatgccataaatattctttataaattggtacgttttagtatcacataagacataattatttagtaaataccgagcatttattacaggtgatttcaaaaagtacaaagaaaagcacaagagaaatatatctacaggggtgaagacagaagcaaaaatcagaggaaagtaaaaaattaatcagtaagtgactctttagcattaattccattttgcccatgtagatttgtattaaaaacaaaaaaagagagtaaataaattcatctgtttgctaaaagtatatacacataaagtcctattcatgcatgcctagtagttccaaaaaattcacagatacccattgctaatacagaaaattcataagttagtcgctgcctaagttaactaaagtgaatcagaaatctggagttacttctatgagattatatttattctgtatgaaatattcttcccaaatgccctctacacttcaggctcataaattattaatgagtgttatggttgttagaggacaatgtatggaaatttacccagattccaaaatcctaaacaaaaacaaatgattaaaaatgaaaggcagagaagaaagaaaacaattatattggtttggtgagagttgaaacatttattctactccatcagcactgattttaaagatctgaatgacaacaaaatgatgaataattcagatttcatttattagtccactgaccctacacatggcttcacaaaaatgaaaacaatgtttttctcctgcttcatcctccatagaatggatatgtgtatgtagctgggtggaatttttttgatgtcatatgctcccgtatattgtatacacatatatttgcatatcatatatttagaagaaatgttgagataaaaatatttttaaaacatgtataaaggagaacattttgccccctactggccaatgactttggtctgcataaaacaatgctgatgatcatgcaacgactgcttacctggcaactagaaaccagacactgtagcaatacggttctatgtcctcagtctgggattgacatacacacaaaaagaattgtcacggatgcatctgcagggctatattctagaagattatgagttttttcccatggcctcccatctccactataagaacataaagctaccacactaaatcttctagcttaggatttacaatagttggtgatgctattaaacaggacaaagattccaggaaaatgaacatatttctcgagggtaagataaattaaataaggtcattcttcgagcaggttgaatgtgacaaatctttgggttatcaatgagagtctactaggaaattggaaaaatttgctggtatgatttgggcagggagggaattattaacagtttatgttgttcttgtcattcatttgaaagtcacttatctccgataatattaggtaatctattattacctttgtttgtaggtactatctcaccatcttcttaactccacttagtcaaagttcaataaatgttttccaacaaattatataacagagtattcaaattaaagtttttgcttgtgatcctgtgaaaattgatactaaatgtcaaaggaatttgcaatatcgtcttactctgtaagactttcaaaaataggtatatgaaaaatatctataagactcttggtataagagacctctcaccttcattataggtataaaagggccaggagtgaaaatttatgaagaattatgcgtgatacttcttttgtttgttttttttggagatggtggaactctgggctccattagcccccactggatgaggtttggggggtggtactgccttaaaacttagggagagagcttaatatatgccttctacagtttttggatactaatgaactattaattaggaggctggcctaagatcttgtgatggtaaattagactagagagctgtggcttataaataactgcactctcagaatttgttaaaaccaaggatctgcaaatattttctgaggttcagacatggcctatatcgatagcagagagaaagctggtggtgggcttgccataccctaccaatagggcacgtaaagggtgaaaacacacatcaacagcaaaatgtttaaggcattccagattcccagaaactgagaaaggagtaagaaagaagctgaagatgactttgccatcctcaaaagtacaccccaagtgagagttctcacaagataaaagtgtatgcctatgggatatgcctaattcagaaagtgtcaaaactagatggccagaactctaccagataacaaagttccaactctctctagctcatcaccttcccagcttccacgccaaagaagtcatcatttttttattcacaagacaagaaagaataagtagaatggtgagctaaaggaaacatatctggcatctttccctagcagcagtcttcctatttacaataggcttacactaggagaaaaaaaagagaacacggtggagaaaactgtaattagagaattgggattttattctgcaacttaaggttactctacacctttatattataattcctggaagtgaatagacaagtcttgctgcctgcccaaattttcattcagggtcatgggcaaaagtagccccactaagcagaggtaaggagactagaagagaccaaagaaattgctttaagattgtgtcctatgagttgtgcttgtgcaatattccagttacaatgataacctcctaacatggtcggaagtcagaggatgcttgagtgatccagcctgtggtccgctcactcctatcttctgcactatctgtctgttgggattcaatcaggctggtgggaaaaacattagagataattatagaaataaacacaaagcttcttggaaggccaagaagttttgataacttctgtaatagatctgcaggtcccattacctttagttaagggaatatagagtagtttatctagctagcttgttcactcatgtggtcttaagattaacctttgatgtaccacgggtgcttaagtgccttttacttgggaagtccacaatgtcaattactctccaatggtgttgactcaagcttttgttagttaaacttactgaataaatgcaaatctccctagctcatggaggccaactgcagtgacaaacttctcttggtgtgtaggtggtcagacactcagcaggactggcaaaacagaacatctgtgtgtcagtgtacgttttattcatccatcgtttgggtcagggtctgcgggcagacgcccgcagctaatgccctcttgtgaggagcaatacctcatctatgttaattacacaacctttgcccacacacgtcaaagatgatacaagatgagtattttgtgagtgtgtctgttccactgttatcagttctaattttgaaaaattaaaaaatgctttagtgaatgtaagtatacttccctaaactttccatcatgttgccctaattctgccttttctagttacacagaataaattaagtgtctctttcctatgatagctcctagggttctcgaaaagaaccattattatagacttgttttctcagcctactcttctccacaccaaacaactccagtttctactgctcctgggagttcttttcaccacttcctgagacaaggtgtctgcatgttaggaagcattccacctctccttaagatttatgagcaacacgtgttcttcaactatgaactataatggacatcttcataattagatattggtgtactttccaaatataagctttttgataaagtggtgaatttttgaagttagtagtcagatatttgacttaattctgagagctagctgctattctcccatttctcagttgcccgtgtggaggggcttcctagagtagtgctccttgcctcttgcctatcccttgcttatgcatcctcaaaggatgtgagctaccaagttcatgagtaaccaccattgctccactgtttatagcaataaccttcttaaacattttgagcaattgggattaactctctccgctctcttcttgataccaagaagagacaataatttcaatagaccgtaattttatctagggtaacctgtcccaagaagcaatcagcaatgggagagagggcaggagaagagtaggcaggaagaaatgggagccaggaaatagcatttcatagtcatttttaagctatattctccaaacagtgttaccctcattaactaggatatttttattattgtcacaattagtggtgaagaaaaaaatgaatgcaatttatgccctcaaatttgaatacctggttctctgattaggtacccaggaaaaagaaaaagacaatgagttgtgtttgaagagcacttacagactttgacttcaataaacttggttacatggaactttgacattgactgtcacagctaattatggctagaatctgtaagcggagcgtatttttaatagggtggggtgtttggataattcaagttatgaaggcatcagtgtgtggtctccagcaactgatttggaaaaatagaggtgtggcttgtatctaagcaggcacagctgaggcaaagttttaattagagagaaaagaaagtttttatgtagacaggctttttaagcattgggaaagaataatttttattccttttttgtttctctgtgtgatttgcaaacaaggaagtcaggactgcaaaggcagttgagacctacctttactatagagcactaagactctagtttcaaactgttagttgcagactgagatgtaaagtaccatatcagctgtcccaaagtccctcttgctgagacaaaggagaataagatatgggcaagagtgaattttagactttaatttatttggtcttttaatgcaaaaattcaataaaatttgatttgggactttgaagacttggtctgcaatttctaagggcttaaacttgtaacatactctgtgaactttaatatctctttggaaaattcataataagaatgaatttatataacaattatgagtacctctaaattgtaggccttaaataattggtataacttaatgctgtcataaattcattacgtaaaacctatgttgagctattgtggactacatgtctggaaattttgcaacgataatcaaagagggagtgaactttcagccctgaatatagtgaggcattgataagatttaatcaatatgttgttctaacctatttctgagatttctggagacaaaatgtgcaccaataagcaacagttcaaagacaattcagagggggacaattgttagagacacttcactcaaatagaagccggacttgcccaggcttaatatttcagataactggattaagacaaccaaaagcaaaagaaattcgtggaaaatgactcagggaagaaacatttaacccccatttcttcagtctccatgtggagtcaccttgctgaagcaatatatttgaatactttccaacttccttcttgtccttttataccagaggagtacgatacctcgttggtgaaagatggccattggtcaacctttctcagttcctaggatctgatctactaaaaagcaaaaacatcaataatttggtctcttttatttcctctctgcctgtggccaaagaaaaagtgacactggataaatccatctactctgcagaaccaaaacgtccttcaggtgggctatttgtatagctagactgggagaagaaaaggagagaggattcgtaacataatctgatccttatatctgagccacattcttcaaaataaacaaacaaaaattaagaaaatgtgtcagcagacatacagtaaaagaaataataaaggaaattcttcgggcagaagataaatgacctccagagaaaaacatggaaatttaggaataaataacaaatattagaaatgtaaactgcatgggatacaataaatttaaaatgtataatcaaaatacataacaacacaaatggtgggcaataagtggtagatgaagttaaagtgtgtcaaggtcctagcattatcaaggaagtggtcaaagcaatcattttcatttgactacaataaacaaagatacaatgtgtaattgccagattaaccagcaaagcaacaggagaaaaacaaaacaagaccaagagtttctaataatttacagaggaaaatagactgataaaaaataccaaataaagaagacaagaaagaacaaaaaaaaaggcaacataaaacaggtgacctaaatagagacaaatatcataatgttaggaaaaataaacatgcctagaagtagataaaatactcaggcaaaaaatctcattgttagacaggatgtaaaaacaaaactcattacattatgcttctaagaaaactacctgaaatatacagatgtcaagaagttaaaaataaaaagataaaaaagaatataccatggaaacattaaccaataggcttctaaagctatagctcaaatagatttaagacaataaatgaggtggagggagacatttctcaatgataaagagatacggtagaccaggaagatattataatcctaaatatatgtgtatcaaacaatatattttaaattacatattaagctaaatttcatagaactaaaaagaatacacaaattttaataaaattatctcaatcactgatagaatgagttgccaaaaatcagtaagaaaatggaaaaacacaacatcaaaaatacaacaatataattgataaacacaacctatagaactttcacccaacaataatacccatttttcttcaggtgcaatatttactaaaattgatcctactctgtgtcataaagcaaatcccagaaaatgtcaaaggattaaaataattcagggtttgttttctaaacacagttgaagaaacctaaaaacaaataactggaaagtaactagaaattcccaaaagccattcactgaatcctaggccaagtaaaaaagacaacagaaattagaaaatcttttgaactgagtcataatgaaaacatgaacacatgaaagctagttggatgcatctaaagaatgattggggccgggcgcggtggctcacgcctgtaatcccagcactgtgggaggccgaggcgggtggatcatgaggtcaggagatcgagaccatcctggctaacaaggtgaaaccccgtctctactaaaaatacaaaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaaaaaaaaaaaaaaaaaaaaaaagaatgattggatgaatttctttagccttaaatgaatacattagaaagtgaagaacaagtaaaagttaattaagcctctgatatctccaagcctccaaatctcatgttgaattgtaatcctagtgttgtaggtggggtctggaaggaggtggttagagtatgggggcagatttccccactggtgctgttcttgtgatagctagtgagttctcatgagatctggtagtttaaaagcatatgatgtcttcccctttcttctcttttcctcctgctccagctatatgaaatgccttcttcagctttgccttacaccatgattggaagtttcctaagacttccccagaagcagaagctgacatgcttcctgtacaggctgaagaaccatgagccgattaaacctcttttctttataaattacccagtcacaggtatgtctttatagcagtgtaagaatagactaatacaggaaattggtactgaggagtgaggcattgttatacaaatacctgaaaatgtagaagcagctttgggattgggtaacaggcagaagctacaagtgtgtggagggcacaaaagaagacaggaagatgagggacaatttggaacttcctagggacttgttaaattgttgtgaccaaaatgctgatagtgacatgaaaagggatggacaggctgatgaagtctcagatggagatgagaaaattattaagaagtagagcaaaggccacctttgttatgctttagcaaagagcctggctgcattatgcccctgctctagggatccgcagaactttgaacttgagagtgatgatttaggatatctggtagaagaaatttctaaatagcaaagtgttcaaaattttgcctggctgctttcaacagcctataatcctatgtgtgagcaaagaaatgacatgaaattggaactcatattttaaaaagaagcaaagtgtataagtttggcaaattcgcagcctggtcatggagtagaaaagaaaagcccattttcaggggaggaattcatatgggctgcagaaatgtgcataggtaaaaggaagacaagtactgatagccaaatcaatgggagagagctttgaaggcattttagagatcttcatggcagctcctcccatcataggcccaggggtctaggagggaagaatggtttcctgggccaggtccagggctccactgttctgcatagtcttgggacactgctgcttgcatcttggctgctcaaactccagccatggcccaaaggggcccaggtacaccttaggcctgtacctgcttcagagggtgcaagccataagtcttggcactttttacatggtattaagccagtgggtgcacagagttcaagagttgaggtatgggagcttccacatagatttcagaggatgtatggaaaagcctggatgtacaggcagaagccagattcagggatggagccctcagaaagaacctcttctagagtagtctggagggaaaatgtggtgttggagcccccacacagagtccctaccggggcactacctggaggagctgttaaagagggccaccatactccagaacccaaaatggtagatctaccggcagcttgtactctgtgcctggaaaagccgcaggcactcaacccagcctgtgagagcagccatggggcctgaaccctggaaagccatgggggcagaatggcccaagggtttgggagcccatcccttgcatcagtatgtcctggatgtgagagatggagtcaaaagagattattttggatctttaagatttaattactgtcctgctatgttttgggcccacgtgtggcctgcggctgctttcttttggatgatttctcccattttggatggaaatatttacccaatgcctgtacctccattgtatgtggaaagtaactgacttgttttttttactttatatgctcatagatgaaagggactagccttgtctcagatgagacattaaactttggacttttgagttaatgcaagaatgagttatgattttggggtaactattgggaagtcatgattgcattttgaaatgtaagaaggacatgagatctaggagaggccaggggtggagtgatttggtttggctgtgtgtccctgcgaaaatctcatgttgaattgtaatcaattcaaccaacaccagtgttggaggtgggcctggtgggaggtgatcgtataatggtggcagatttccccattggtgctgttttcatgtagtgagttcttgcaagatctggttgtttaaaagtgcgctgcacctcccccttccttctctcttcctacttttttgggcatgtgaaatgtcttctcctgctttaaattccaccaggattgtaagttccctgagaccttcccagaagcagaagtgacgatgcttcctgtgtagcctatggagctatgagccaattaaacctcttttttttttataaatcacgtagtctctggtatttctttatagcagtgcaagaacgaactaatataaattccatattgagtaactagaaaaagacatctgaacaaatccaaataaagtagaacaaataaaataagaaacagtaagaaatcatgaagtagtaaatgaaataaagaaaaatcaccaaagccaaaagttgtattttttaaaagattggtaaagttaatgaacaatgtagacagctgattaagaaaaaaaagaaataaaacattaatgtctaatatcaggaatgaaaacttaacctcactacagaagctagagaaatttaaaagatagtaagtgggtattttttttaaaaatctatatcaacaaatttgacagtaaaggtgaaataaatttgttggtaaactgataaaagagcaaatagaaaatctaaataatcctatcataaagagtctgaatattaataaaaacttttccaaaaagaaaaaattaccagtccagattgcttttatgttgaatttatatatgtatgtgtgtgtgtgtgtgtgtgtgtgtgtgtgtatttaatttagacagtcttcaagacgataaaactcattttatagtgctagaagaatgctgacaaaataacatgacgaaggcaacgaaagaaaggcaaaattaagaatgatgtctgtcataagtgtagaggcaaaaacaaaacattagcaattggaatttaatgacacagaaaaaaatgtaatacattatggccaagtgtggtttattgcagtaatgtcaaaatgttttagcactaaaaaaaatcaatacaattcaccacaataaagaaaaaatggaggaaatgatgattacctaggtagatgtagaaaagcacttaaaatttaacacaagatttttttcctaattctattaaacaaggaacagaagaaaatttactagatgtgatgaagagaatctaaaagtaacttacagtaacatcatatttaatgatgaatttttcaacactttacaggagcaaaaaaagaaagaaaaaggatgtctttatcatagtttctgattaactttacacttgaagtcctaaccagggcaaaacgttaagaaaatgagcattagatggaagagaataacacacatttttacaaattgcaagtttattttttaaaatccaaaagacacctcaaaccaatagaactaagtattgtctttggcaaggttgttggggattgaacttgtgatcaatatgtgaaatcaatgataattcctatggataagcaataaccaaaaactgaaattttgaaaaaatattaattaaatcaatgcaaataaattgatccaacaacagacacagaagacctcacctgcaaaaaatctaaaataaatctaaaattgacgagctgattcaaaaacatatatggaaaataaaagactaagaatagcaaagcgatgttgaaaaagaatatggctaaacatttacccaaatatgaaggcttgttataatgtgagcgcaagacagacagtgtactcttactgaaaggagagaaaaatagatcaatagaatacaatacaacaatgggaaacactcatacaagagacagaagaggtagtatagaaacattcacacatatgtgttgctcttatttctatcaagcatgttgctatagtgcagtaaggaaaaggtgaccttttgaacaaattgttctgggtcagttggctatctgtatgctagttattaaatcaatccttacattaaacctagctatcaattccggatggattgtgaaagatataatgacataaattttagaaaaaagtactatattttcacaaacttgcacaagctaagatttctcaatcaagacacatagagcattaattataaaaggaaaatgataaattagactaaatcaaaattttgaagttttatttactgacaccattaaaagaggcaaaatcatgccacaaagtaagattatttataagacgtaaactgacgaagactaatatataaaaatatataagtcagctaggaaaatggcagaaatgtggaaaagcctttacaaaagagtatacatgaatggtaataagcatatggaacagtgctaaatatcattattcgtaagagaaagttaaaataaaaccacaagcaaactttacatatttatggctaattaatttacaacaagggtgccaagacaattcaataggtaaagaatagtcttttcaataaacggtgctgtaacaactagatatttatatgcaaaagtataaaattggaatcctaccaaatactatataaagaaatcaattcaaaacggatcaaagacctaaaagtacaacaaaactcttaagacaaaaacacatacaaatcttcatgacctttgattagacacagtttttaagataccaactgcccaagtaatcatactaaaatttgataaattagactccatcaaaattaaaaacatttgtgcagcaaaggacaccatcaagaaagttaaaagacaacccagagaataggagaaaatatttgcaaatcatacatctgataaaggtttaggattcagaatatatacaaaacaattgtgattcaacaataacaggacaaataacccacttattaaatgggtaaaggatttgaacagacatttctccaaagaagatatacaaatgggaaataaacacatgaaaaaatactcaacatcaccagccattaggaaaatgcaaatcaaaaccacaatgagataccacttcatacccactatgataactataacaacaaaaaagcatcagtggggacagatttgagagactggaatgctcctacattgatgggaagaatgtaaaataccatagccactttggaaacagtccggcagttcctcgaaaaattcaatatcaactacatgactcagtaattccattctttgctatacagctaagacagctgaaaacaaacatccacacaagaacttatacatgaatgttcacagcaacattattcataataaccaaaaatggaaacaaaccaaatgtctattaatggatgaatggataaataacatatgatttaaccatgtaatgaaatattattcatccataaaaaggaatgaaatactgattaatgatagatacaacagggaagaacctggaaaacattatgctaagtgaaagaagcgaaacacaaaaggccacaaattgtatgattccacttatacaaaatgcctaacataggcaagttcataaagacagaaagttctttattattttctaagttctgggagtaaagggaaatggggagtaactgctaatgggtacaagtttctttttggagtgatgaaaatgttctggaattagatcatgataatggctgcacaatactgtgagtatactaaaaaaaaaaccctgaataactcattttaaaggcttaatttcatgatatttaaattatatctcactttttaaaatagaaaataagatcaccatcatgctgtcatatgaccatcatcagaatgaatgaaattaaaaagacaacaaattgttgctacaattttggaccaacagaacttctcacacacttttggtgggcatgtaaattgaagaaatcgcattgaaaactcttttctatttccactaaagctgaaaatatgcaaaacctatgattttgcagttatctccttggcgtatacactatagaaatatgtatgtatgttcacataattcatataatgtatgttacaagtatgtttacatcagtgctacttgtaaaatccccaaactataaacaacccaaatgtccacctatagtagaatggattaaaactactgtggcagtgttcatacaatgaagtgctatgcaacagtgaggatgaacaaattattgctacatgcaacaacatggatgaatctcacaaacgtaatgctgagtaagataagtcatacccaaaagaatacaaactatggccgagcacggtggcttacgcctgtaatccaagcactttgggaagctgaggcaggcagaccatgaggtcaggggttcaagaccagcctgaccaacatagtgaaacctcctatctatcctaaaaatacagaaattaaccaggtgtgctggcacacacctgtagtcccagctactcaggaagctgaggcaggagaatcgcttgaacccaggaggcggaggtggcagtgagccaagatcgcgccactgcactggagacttgagcctgggtgacagagacagactccgtctcaaaaaaaaaaaaaatatatatatatatatgtgtatatatatatgtgtatatatatatgtgtgtgtgtatatatatatatatatatatatatatatatacacacacacacgcatatatgatcccattaatataaacttcagaaacaaaagacttctctaaagcattagaagccaggatacttttggggcaaatggcagtggaaaaagcacagcataagagaccttctgaggctctggtaatgttctattttgatctgggtgctggttacaagagtgggttcactttatgaaaatttttgagttatatatgaaaatcattgagccatctgaaggtgtattatacttcaatttacaaagtttatgctaaaagtaaagagtcaagagagaaaaatcatcataatgtataaatacttaatgtatgttaaaactagcatttcaaatcacttgataaaatttttagagtgcaaaaaacaataatacagctttatgtggaaatccattaatgacttctctccaaattcaagaacaattgatgattagcttcaaatattcataagaatattttccatatttttcctatgtcctgtttgactctttcattgctatggtcaatacattccatatcaatggccttctccagatacaaactttgcaagcctccaaacagaaaatgagaattagaaatttttcttagtgaatctatgatggttcctgagaattaccacagtcttttctagattttctcaatagtttaaaatatctaggaaaactgagatcaagttttacttacctatagtcttaagaatctatattagtactcatctgacaaagggctaatatccagaatctacaatgaactcaaacaaatttacaagaaaaaaacaaacaaccccatcaaaaagtgggcgaaggacacaaacagacacttctcaaaagaagacatttatgcagccaaaagacacatgaaaaaatgctcatcatcactggccatcagggaaatgcaaatcaaaaccacaatgagataccatctcacaccagttagaatggcagtcattaaaaagtcaggaaacaacaggtgctggagaggatgtggagaaataggaacacttttacactgttggtggcactgtaaactagttcaaccattgtggaagtcagtgtggcgattcctcagggatctagaactagaaataccatttgacccagccatcccattactgggtatatacccaaaggactataaatcatgctgctctaaagacacatgcacacgtctgtttattgcggcattattcacaatagcaaagacttggaaccaagccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcaagttctcactcacaggtgggaattggacaatgagaacacatggacacaggaaggggaacaacacactctggggactgttgtggggtggggggatgggggagggatagcattaggagagatacctaatgctaaatgatgagttaatgggtacagcacaccagcatgacacatgtatacatatgtaactaacctgcacattgtgcacatgtaccctaaaacttaaagtataataataataaaataaaaaaaaaattttaaattaacaaaaagaatctatgttatactgtttaaaaaattggaaaagggttaattgatctccagtttcaggagatgtcttagtccattttctgttgcttataacagaatatctgaaactgggtaatttacttaaaaaagaattttttcttataggtatggaggctgtgaagtctaagatcagggtactgcctctggtgagtgtcttcttgctattgaagactctctgctgagtcccaaggtgacaaagggcatcacatagttagagggctgagtgtgctagttcaggtttcccttcttcttataaagtcatcagttcctctctcatgataacccagtaatccattaacccattaattaatgatgtattaattcctgaatggattaatccatttgtgagggcaaaaccctcatggcccaatcacctctcaaaggcctcattctcaatactgctacattggagattaaattgcaacataagttttggagaagacaaacattcaaaccatatcaggggatattcccatgatttctcaaatagttcagcattattccatgtcaatgtatatatttgcaaaagaatttaaaatttcatttaatcccagtttttattatcaactacttctgatcattgatgcttacaataaaataaataattttgatatttgtaatattacaaactgtgtatctccttacggggagaaaaaaattcgttttattagctactaaatcttttacgtttgttaagagtccacaagatttttcgaggctgaattcaattccaattccctgccttcacattaaagtctacataaactgctccatatgaatagttatttaatattttattacagcttttaattttactatcccctcagtaacttatttccctgcttacaaaccttatggtcaagaaattcttcccaacagcaaatataaattttccattctggtttcctagcattaaaagacttattaaattttccttacctccaccctgacccattcttctctaacaaaaccacaatcttttacattctcccttccatttctaatgccatcttttgtcatgcattagctagtaccatataagctgctgcaataaaagaacatagagtatttgctaaaataatcaattaggatcagaaagctgggttcagactaacctttactgcaactgtaatcataattaaatttcataacctctatcagcctcactttcctgatctgaaaaatagaaataacaacagtatccacttcataaatttattgtgaagattatatgatatggaatatgaagtaagccaatgccttcttacactaagagctcaataaatagtgttgttataattgttatcgtagtagtagtttctgcttacaaataaatgaaacagctaggttaacccaaaaaatgggagaatagggcagagaatatgcatgatgcttggtggaagaactcaagaaataatcctttgtagttacaataataaataatgcttagcagactgcttatagttataataataaataatgcttagcagacacacagcagttagggtcactgaggggccacagcagctggggctccgcactgttcagcataaagggcacacaaccccaaagctgctctaactctccactccaaatttcaaattcctaggagagaatgccgaattactccaactagattcaggatatgtattactcttgggtcaataagcaaagaacagaaggccacaggtatcaccaatagagatacactcctgtgtatgaaaccaacatcaagaaagagggtattggatcaacatttttagatttcacataagagtgagatcatgcagtattttctctttctttccctgaaatagctattaagtgttctctccacaaaaatgataattatgtgaggtgatgcatatgttaatattgcgtaggtttagccattccactatgtatgtatgtatgtatgtatgtatgtgtgtatgtatgtatgtaaatcatgttgtacatgataaacacatacaattttatctgtcaattcacaaaataatgtttttgaaaagaaaaaaacaaaagaaagtgggtattgggcggccataccccttggtgttgttttctatcactgatagcgctactatagcagcagctactactgctcctgtaatttctcctactgctgttactgctacacctccttttattattattagcaagccactttagtccttcatctagaattgatgagaagacagtaaacaaaataaaaatccttgccctgcaaatcacagaggtttggaaattgtgactgctgcccactatgataccacaaggaaagaaaaaagtcacgttgaaagatatttatttagaggaattttaacttcatcaatttaaagatataatcctattcccagacatataataagaataacttccagaatccctcagcaaacttgaaacaagaaaatataacaataacagctttcaaatacttttactatgccctgtaatttgtacattattttttactttaccaaacacactctaaaaaatattaaatttacacatcatttctgcctcaacttggcaaagtattgcaaagtacatatttataaagcaagattcaattaaaatagatttaaattatctaattttgactaaattccttatttaaataattattgatttagccaagtaaactgccatggatactgtattttgttagttattaccaaacatattcaggctttcaaaagtaaacaacacaccttataattaggcaatatgaaattaatatgaatggtctagcattatcgttactatttcccctaattgaaaggcagctagctagtatactaaggaaaaaggaatgaagtttttaaaagtattggaaaaagaaggagtctatgactgaatagaattatttttatggattaatctaatttgctaagcacagtagcaaaataaagagcaggtgaataagaaatgcacaatccatgcaatgttttgaatgtttttgtcctctctaaaactcatgtgttggaaacttaagccccaatgcaacagtgaggtgaggcctaatgggaggtgggcaggtcaggagggttctgtccttatgaaaggattcatgaacctattttctactgcagaagcggcttccaggagtgggttctctctctctctctctcttgctcttctgtcatgtgaggacacaaagttcctccccttgggaggatgcagtattcaaggcaccagcttggaagcagagacaaggtcctaaattgtgcaacaaaaataacaaagattttctttacatctaattagacataaaggctagaacaatgttcttgtgaaaggatgcttttaagatgcttttttggaattgaaatagtaacaacatttgtttttttgtgataaacacataccaaacctgatggtgacttgatcttgaagttctcagcctccagaaccaaaagaaatacatttctattctttataaattacccagcctatggtattttgttatagaagcaccaaatggactagaaaaactgagtgtgtgttagagtaataggaaaaagcattgactttgcagccaaataaccctgagcacaatcctaactctgccacttatttgtcaattcaagaaccagtttcaaaatttatttgatccccagtttcttcacctgggaataggcacgttagaatctaacttaattatttctctgagaagacaatatacagaaataaaaaataagggtctagcatggagcacagcacacaataaatcattagttcacttatttcttaaattacccttacagatgcacaaaatttaagttccattcaaatattacttaaattttttcttcaaatagatcaagcttagcatccatttgattccaataaaaggaatgccaattacataaagataaagacttaacaacacagattagtcaagggttttattcaaggctgaatggaagccttcggtcaagtcagaaaaaaagcctaggtctcttgacttttagctatgtgctaaaatgtactctgccttacctctaggtgacatctgttccagagtttttggatgcttgccatatagtagccatactacccacacttgaatatcagagcagcaacaaatacaactaggtagaaagtcaaagatattcaccacgtttggaaaagaatatgttgcttgtgtcaaaaactaaattaaaacggtaagcaaagagaacaaacagcacactgagaaaaggaatctcaataggggatttttatcttggtggggtgaggagggtggtggaggtggagattgcacacatgaaaaagaaaaaaaaatccactggtgtaatttaccttgcaaatacagtataagtcagtcacctctccattctgatgtctttacttactatccccatcccatccagactcaacagaatagtttagttacaactaaagaagccaatagattcatggcatgttctagtagaaaacatacaaaatgagaaatggagagaaacctaggctgttttcccaaaaatatttatggaaaccacactacaatgttcctgaagaaacaaaaagaagaagaaaaggaagattactgtgaggtgaaaggaatcaggacaaagatgaaagaaaaataagcatagaaaagaaaggcctttcacaggatttgtactgcacatgtgcacttattttattcagaagaatgttgctacagaacccagcaggggtaaactattatttatctctggttattagccaagtctaaattgtgtaacaaaaataacaaaagattttctttatatctaattagacataaaggctagaacaatgttcttgtgaaaggatgcttttaagatgcttttttggaattgaaatagtaacaacatttgttttgtgtggtaaacagaagccttttggcagtgcagttgctttcattttgaaactgccaagaattatttgcttatctgtggaatttcaactactttccctgcctgtgagtcatattgatgctgatctagaataaacaggactgcacagaacactgggtcttactgtggtctttgggcaatttcctcccacccttgcccaacacacaggggcaggcattcacagtacgccactaggagagggtaaaagaagtggaaaagagagaagataatgcaaagggagagaaagaagagacacacaaaagcatgataaaaaaagaaaattcaacaagggagggaaggacatgagagaaaaggaagagaaatgtcagagaggatgacagaagtcctagagacataaagaagcagaaaagaaaagtgtcaaaaaaccaaaataataaaaagaaaaaagaaggtggaaaagggagaaatgtgagagggttaggtagatagagcaagaattcagaaagtacagggaataacagtgaaaaagtgggaagaagcttggaaagacttcatggagcaggaatagcctaatataatttggaagggactgcagagttgtctaaataataatgctatttgacagtttgatatgtatttatagctgattccagctttctctgaatattatataggattatccagattttctggggtttatcaccacaggcatgtaggattaacagcctgatgaagtgaacaattatttttcaatctgatccttaggcttgtagagcacttttcccaagttccctgaacatagtacataaaatgcaataaccaatggaaaactgtgtgcatgtgtgtacatgtgatgagtgtgtacacatttatctatcaacatctaaaattcttcgatctgggcttaaaatctacaaaagtactaggttcagaaaaatgccttaaagtagcaagtgttattgttcacctatgatgtgtcagacaaagggaattaagtgggaaaaaaaataggagacagagtccctgtctcatagtgctcagagtccagaatgtagggtatgtggtaagtggtatgtcagagatagtgcagagctacaggaagcatgtaaccagagacccagcttagtacaagtgggaatatctgtttgaaaacttaaaaatgattgaaaactaaccaggtaaaaatggaaaggggttagggatgttgcaaggaaacaggaggatgttcaaggcagaacagagcaaaggaatgatctctttgctttacagtacgtctttttctatgtctgtgatcacaaaatataatgacagtgttgagacagaatgttgtgctggaaggagagacacatcatgaaaagacttgcagatctgctatggatctagggttttataatcagggcaattcaaacattgtctgggagagggcaggcttgagaaaggaaaaagaaaaaaaaagaaagaaaagttgttcagtaagggattaccaatacaacattttatcttctaaatactactctttgaaaagtagatgagaagtggaaaagactggtgtcaagaaatccagttaaggagctcttataataacacatacagtagaagaaccaaggtagtggcagtgaggtgagagcgaggaatttggattcctgaaatactaatttgcagaatcaatgggatttggtgattgctacatttggagaagtaaggaatcaaaaagtgaatagcaagtcaagaagttataggaatttcaaattctttgacatcaagaaacatgaattcttagcaacagttttggttgattgaactgtactgtgtactcctgtgtcttctgagtttctctttatgtagatatacgttcattaaacaaattcaacaaagacttattgaacgaatagttaaactcatgagtgattgcaagggaatgaataaatgaataaatacaggcacaaatgaaagaacaaatgaatgagaggaaaatcaaggaaacaaagagtcaatgaacatatgaaagatttcctcatcagcaaggatggtaaatcatatactcaaaatagagcctcctagttttaggaaatctagaactcaagatgctaaatggggtgcaaaaataaaatgcacaacaaaaacagcctaatgaagcttcattctcaatagatgcagaaaaagttttcaataaaattcaatatcttttcatgaataaaaaaagaccttcaacagactaaatatcaaaagaatatgcctcaaaacaataagggccatctatgacaaacccacagccaacatcacactgaaaacgcaagagttggaaccattccccttgagaactggaataagacaaggaggcccactctcaccattcctattcaacatcacactggaaatgctagccagagcaatcaggcaagagaaagaaacagaagacatccaaacagaaaaagaagatgtcaagctatcactcttcactgacaatcttattctatacctaaaaaaccctaaagattccacccaaaaggatcttagaactgatgagtgactttagtaatgttgtaagatacaaaatcaatgtacaaaaatcagtagaattgatataccaataatattcaagctgagagtcaaatcaagagcacagccccatttacaatagccatgaaaaagtgaaatatctaggaatacagctaaccaaggaggtaaaagatctctacaagaacaactgtaaaacactgctgaaagaacttagacacaacacaaataaattgaaaaacattccatgctcacggactggaagaatcaacattgttaaaatgtctatactgcccaaagtgatttacagattcagtgctaatcctatcaaacaaacaaagtcattttttacaaaattagaaaaatctattctaaaattcatatggaaccaaaaaagagcccaaatagccaaagcaactctaagcaaaaagaagaaacacaaagaacaaagccaggggcattacactacctaacttcaaactatactacaaggctacagtaaccaacacagcatggtactggtagaagagacacatagaccaatggaacagaatagagaacccagatataaagccacaaacctacaaccatctgatctttgacaaagtcaacaaaacaagccatgaggaaaggactccctattcaataaatggtgctgggataactggctaactctatacaaaagaatgaaactggacccttacccttcaccatacacaaaaattaactcaagatagattaaggacttaaacataagttctcaaattataaaaattctagaagaaaacctaggaaataatctttctcaacatcgaccttggcaaagaatttttggctaagtcttcaaaagcaattgcaacaaaaattacaaatgagacctaattgaaccaaagagcttctgcacagcaacggaaactgtcaatagagtaaatagacaccctacagaaggggacaaaatattcacaaactatgcatccaacaaagttccaatatccagaatttgtaacttaaatgcaaaagcaaaaaacaaacaacctcatttaaaaatgcgcaaaggacatgaacagatacttctaaaaagaagatgtggccaacagaaatatgaaaaatgctcatcatcactaatcatcagagaaattcaaatcaaaaccacaatgacataccatctcacgccaatcggaatggctgttattaaaaagtcaaaaaataacatatgctagcgaggttgtagagaaaagggaacacttatattccactgttggtggaatgtaaattagttcagccactgtggaaaacagtttggatatttctgaaatctcccagtggttacccagcagttacccagagttacccagcagagttgacccagcaatccaatcactgcctatatacccagcagaaaataaatcaggccgggcacggtggctcatgctcgtaatcccagcactttgggaggctgaggcgggcggatcatgaggtcaggagatggagaccatcctggctaacattgtgaaaccccgtctctactaaaaatacaaaaaatcagctaggcgtggtggcgggcgcctgtagttccagctactcgagaggctgaggcaggagaatggcgtgaacccggcaggcggagcttgcagtgagccgaggtcacgccactgcactctagcctgggcgacagagggagattccgtctaaaaaaaaaaaaaaaaaaagaaaagaaaaagaaaaagaaagcaaatcaatttacccaaaagatacattcactctatattcatggcagcactattcacaatagcaaagatatcgaatcaacataggtgcccatcaccgtggtacaaatacaccgtggaatactacacgaccttaagaaagagcaaaactatatcctctgcagcaacatagatgcagctggaggcctaagtgaaataatgcatgaacagaaaaccaaataccgcatattctcacttataagtgactaaccattgagtacatatggacataaagatgaggataatagacactgggaactactggggagtgggggagagaaaaggaggagagatgggttacaaaaaactaccagttgggtactatgcttaccacctggatgataggatccatactccaaacctcagcatcacataatatacccatgcaacaaaccttcacatatacctcctgtatctagaagttcaaattatagaataataataacaacaaagcaaacaccatataccgtctttaaaaaaaaataaatgcagaggatttttgaaactttaaatgtaatagaaaaaaaataaggaaaaagctcattgacattggtttgagcaacgattttttgagtatgatcccaaaagcttaggccagcaaagcaacagtagacaaatgggattacatcaaagtaaaaagcttctgcacagcaaggatacaatcaacagagtgagagacaacctatgaaatgagagaatatatttgcaaaccatatacctgataaggagttaatatctatcatatatgaggaattcaaacagctcaatagtaagaaaacaaataacctgatttaaaaaatgggtaaaggaccttaatagacagttctcaaaagaagacctgcaaatggcgaacaggtatataaaaatgttcagcatcactaattatcaagaaaatgcaaattaaaaccacaatgagatatgacctcacacctgttaggatggctattaccaaaaagaagaaaaatatcaagtgttcgtgaggattttgagaacagggaacccctgtatcctgttggtgggaatataaattagtatagccactatggagaaagagtatggatgttgttcaaaaaattaaaaaagaacaaccatatgatccagcaatcccactactgggtatatattcaaaggaactgaggtcaatatgtcaaagagatatctgcagtcccatgttcactgtagcattattcacaatatccaaggtacggaatgtcctaacctaaatgtccaccaacaagtaagtagataaaacatgtggtgtatacacgcaatggaatactagacagcttaaaaagaaggaaatcttgttatttgcaataaccaacataaatgaacctagaggacattatgattggtgaactatgccaggcacagaaagatacgtatcatataatatcacttacgtgtggagcacaaaaacgtcaaactcatagaaatagagtaaaatggtggttactagaggctggggagtataggattaggaagatattggtcaaaaggcacagaattttcatgaaacaggaggcataagttcaaaaggtctattgtatatcatgttgaacacaattaataacactatattgcatattttgaaaaatgctgggaattgattttaagtgttcttgccacaaaagaataagtgaggtaatgtatgtgctaaaaagcttgatttagccattccacaatgtatacatatatcagatcatcatattgtacaccataagtatgtacaattttactagccaattaaataagagaaaaatgaatgcataagttttcatcatatataggtattgatttttccagagagatgatcagtcacaaataatggtatcctcattcatgcttttttaaaaaagccaaatgtagacttgaggctctagcaaatgagtgctgacttctatcttactgcatccttgaatgcatatacgcttactcagtgatcgtttgtaaaagacaaagcagggtgcagaatggtttcatttcacacctggaatcagctctctggggaaattttaagatcaaaacagtaaaacaaacagcaaggtccagtagaaattagttcttaacttgctgcattttaacacctctctggccatacaaatatgcccacacaggtaactagggtagagaagtggacaccacctagtgtatgctaagtaattggatcatcacctgaatgaattcttccacccttatatggtactttcaatataacttgggaaaacttctctctcattcaactcattgtcactagatttaataattcataatgtagttatctctaatgctaaaggataggatgttttggctgataacagtatcagtgtataaatccgtcagaaaagggcaaaatcttaggagctcactatggatcacaaggttatgggtccaaggtagaacaagcatgattgctctaatgcttaaactatcatgctaatttctatatataaaataatttttattaatatttctaaaatttcattatctattgctcataactcccagaaagtaatataaattttagttcctgaagaatcattagctatttaagaaaacattcaaaacacaagaacatagaaagaattttccacttatgttatgagttatttaacttctaaaaatctttttctcctcctctttaaataagaaaaattattatctctgaggctattgaaaagactgacttagcgcatgtaaatatttaacataccaacccatattatgagtgtaacaaaagctaacataatttattttttaacaatcctaactctatgggaaacaaaacagaaacactttttccaaccagttccttctaacaggccctgctggatctcctttctcatccttgatgacatctggaatgattctttcaggtttttggctgaaatgaaaatcagattttgtaactaagaattcactttcaaataatacagtctagaccaaaactgcaatttcctacccatttcaaacagtctaccctcacatcaatttatacatgatccagtcttagatacctctgcaggggaaagaaaggtccttactcttccttttctttcacttcttctgctctctttctttcatttgctccttctttccctctgttgctgcttggtcctcttcctcgtccatcatattggtactcaagagaggggattaataaaagtgctgctgtaatctgaccacttgttccctcagcatggcagatgcccgaatgccagctagctcacttaggagaacatttgtagctcttccatggagattacagtgaccttcccattgtacactttcctcaggcaagcaaaacaatatccacctgacctcttgcaacctcccactgttcattttctgctatcagcagatgctcctataacttcacgccaccagggacgctttgccctaggcaagctatcctcataggcatggctccatccaaatatcttcatcccgcttatcttatgaggtgctcagtgagcccataggaaactcatgcattcttgtcaaaccaaaagttgaatgtttcctctgcttcttatggccttcctctcttgtcctgctgtcagacatcactccacaaagattgccaactttcacattctcagagcaggagtcaaaaaatagtctctttatttaagtacactctaaaaccctcagaatgcacatcaggcacttccaagaatttcctcccttcatcctactcctgtctcaaaataaaatacacgaacaagtctctgcagctcaacacacttccagctagggtatgagatgtcatcacctcatcttgtaaccacctcaaatctctgagggattatcttggagtctccctcacttgacttgaaggtaaagaagagaagaaaaaaatactttacccttaagcctatgactccttattcacacattttttcttcattttttttatcttctgactatataggttgagtagcaggtgaatgaataattcaaaagactgtattattaagtcctagaagaggatttctcaatcacactttggacaagaactctttgttggtttgaggaggctgatctgcacactgtaagatgtttagcagtgtccctaccttctacccattagatgacagtagcatttcctccctctcaggtgtgacaaccagaaatgtctctagacattgccaaatgttctaggtggggcaatattaccccagctgagaatccctaccctagaagaatgttaactagctacagttgagcattctctttagattatggaggtattctttgtactcctcagcttccgggttttaactaaaattttaagagcaaaggtcatgtacttatattagttccccattccttatatctgtttgtctgttgattaagtggacattcattttattcactaaataaatattcatgttctgctttgtaaaagacactgcccaaggactgagtaaacagaccctgtcccatgggagattacaaggctgacgatacttgagatatcatagagacttcaacagatacacaatataataaaagtggtgactgaagatgacctgggcatcattttgcataatgaaaagaaagggaaattttgaagctacagagaaaaattagaaaacagtggccatttttaaagtaacaatgatctaagtttgacccctggcaataaagaggaacgaataaaacagaggaaatttttgaagacaacagataaaattttgtacgaggctgatagatgaaaataagaggggaaaaaaagagttcttcagtttcagtttaacgaaggggagatttatcacagttgtgctaccacttgaagatacagaattgttgggattttttacaaaactgctaggcagatgattataacaaagcaataactagttgggtttttggaatattgatagttggttagtttgaccagaggatgggctattcaaggcaattccgtatacagaaatccaggatatgggcttctccagaaaagatgcattgttcttcatctcatttttcaaggacactcttaagatatacacaaatggattggtttattcctcaattatgttttgagaaaaatagcatattaccaactcatattctcaaactagaattcaggctattccacaataaaacacaaaatttaaactgcctctctgatgactttacctaagcagaatcagcctaaagacaaaaagaaaatattttatcttcacagatcagagatataaatcttcacagaaccttaagatgacaggtattttaaaaataaagtctaattagaaatataagaagcttttctttaaaataacagggcaattggacagcacttgttaaaataatcagattctaaagatagtataaaaatataagtggccataaaattgcttagcaaaaaaatgttttatgggaatagaataagaaataagaactatttcttattcctcctatttgccccttattccactgcattttctctaactttaaatcaagagggttaaatttagaaaactatcgttctatgaaaatgaacctattatgtcatgatcccctcaaacctctgccaaccatctgcagctcccacactggttccttcattcatctccagcttttgctgacatccacaagaacacattttaggagtcctagagtcctgagttcagttctcaagtgtaccctgataagattactctgtaaactcaggtgagtacttctctacaaattaatttctttatttaaaaagtaaagatattactttccccacatggttgttatgataattaaatgagttaattaaagagtcacataatataacaaatacagagttcattttagttgttcttccccttcctttttctttctgccaagtgatttagaaataggagatatgaaagacatgctatacctactgtgtatttgccattacatatgttgaagcaatacagataaaaaagatacagaataatttgtgcaatacaatctgaacaatgtcaaatcaatttttttaaaaccatacataattatgaatattaaaaaagaatgcaaaaacatatatttattaacagtgattattttggatggtagaaaatgaatcgatatttatccctttcactgttctgtttcccaatctttatataatatttaatttcctaatgaaaaatataaataaacttcatagaaaggaaaaactacttaaaggaaactccaatgttctcattaatgaatacaaaggctactgaattcactagtgactcagaaaactaattctcacacaaaataagataatattttttcacaaactgttattttgcctacaagtggaccaaactccagtggtacccatggaatatatcatagccctcaaacactgtgtacaacaatgactttggtcttctcttaaaaataataataatatagtatttttaaaatgactcgtcattattatgataataacattaatctaatcggcttttaaataaaccagtcatctttatacagattaatgcttaataatgtaattcatatgacttagacttttttcttgcaaaagtggtttgcaaatcttaatagttaggaatatatattcactgctctccaggtcagttttccctttttttttttttttttttggctgactttttgcaggtactcaaagtgtttcttaaatactgttaaatactgcaacagtggaagcctaatccacataccacattgccatttcaattcagaatcacatagaacctatttattgtctccctcccccaccatccctagcagtgacctgtaaggggaaaacaaaagatcttagtcaagaactttttcactatattgtaatttgttatctacatatctattttcctctaataatgtgttctcctttaagacggagggggagatttgatcttttttgtgtcccttgatcagttgctggaccacaggatatgttcaatcataaacacttgatgaatgaatgaatgaatgaatgaatggtttgaaatggaaggaatcttaaaagatcatacagcccagtttccactgacttttaaaacactttacctagcattaccaacaaatggtcagctatactccttttggcctcattatcctatagcagaacactcagggaccataattctcttcacctggtttcagaacttaggttcattagaaaccttttataactgaaatgtatatttcattgattatctttcactggggtctcttacatgcctgccttctgtttttcttaaattgaacacatcatactagcataggtctttctaaattaaaattcaaagagcactaccttcaacacatttcatccccatttacactggttttcactgcccgcagtgattgctctggctaagactatcagcactatgctgaatagaaatggtgaaagtgggcagccttgtcttgttccagttttcagaggaaatgctttcaacttttccccattcagtataatgttggctgtgggtgtgtcatagaaggtttttattgccttaaggtatgttccttctatgctgattttgctgctgattttaatcataaagaatgctggattttgtcaaatgctttttctgcatctactgagatgatcacatgatttttgtttttagttctgtttatgtggtgtatcacatttattgacttgtgaatgttaaaccatccctgcatcactggtatgaaacccacttgatcataatggagtatctttttgacatgctgttgattctgttcgctagtattctgttgaaaatttttgcatctatgttcattggggatattggtccatagttttctttttctgttaggtcctttcctgattttggtgttagggtgataatggattcataaagttatttggggaggattcaccctttctctgtcttttggaatagtgtcaataagattggtaccaagtcttctttgaatgtctgattgaattcagctgtgaatctgcctaatcctagactttttttgttggtaactttttaattacaatttcaatcttcctgcttgttatcggtctgttcggagtttctatctcctcctggtttaattgagaagggttatatatttccaggaatgtatccatcaccttcatgatttctagtttatgcacgtaaaggtgttcaaagtagcctggaatgatattttgtatttatgtggtatcggttataatatcttctattacatttctatttgaatcttctctcttcttttcttgtaatctcactaatggtctatcaattttatttatcttttcaaagaaccagttttttgtttcattaattttttgtattttttgtttcaatttcatttagttctgctctgatttggttatttcttttcttctgctgggtttgggtttggtttgttcttgtttctccatgttcttgaggtgtaaccttagattgtctatttgtattctttcagactttttgatataggcatttaatgctatgaactttcctctttgcactgcttttgctgtatctcagaggttgtgataggctgggtagctattatagatcagttcaaacaattttttaatttccatcttgatttcattgttggcccagtgataattcaggagcaggttatttaatttccatgtatttgcatggttttggagttgattcccaattttattccactccagtctgggagagtagtggatattttattttggtaaatttgtcaagacttgttttgtggtctatcacatggtctatctcggagactgttccatgtactgatgaatagaatgtatattctacaggtgttgggtagaatgttctgtaaatatcttttaagtcaatttgttccagggtatagtttaaacccattgtttctttgttgactttctctcttggtgacctgtctagtgctgtcagtgtagtattgaagtcctctactattattgtgttgctgtctatctcatttcttaggtctagtagtaattgttttataaatttgggagctccagtgttaggtgcatatatatttaggactgtcatattttcctgttagactagtccttgtatcattatataatatcactctttgtcttttttaacagctgttcctttaaagtttgtttgcctgatatgagaatagtgagccctgcttccttttggtgtccattttcatgaactatctttttccacccctttaccttaagtttatgtgagtccttatgtgtcaggtgagtttcttgaagacagtagatacttagttggtgagtttttatccattctgccattctgtatcttttaagtggagcatttagaccatttacattcaatgttagtattgagatgtgaggtactattctattcatcatgctattttttgcctgaatgatgtgttttttcttcatcgtgttattgtttttgtaggtcctgtgagatttatgctttaaggagattctattttggtgtattttgaggatttgtttcaagatttggagctccttttagcagttcttttagttctggcttgataatggcaaattctctcacatttgtttttctgaaaaagactgcatctttcctgcatttatcaagcttagctttgctggatacaaaattgttggctgataattgttttgtttaaggaggctaaagataggaccccaatcccttctagcttgtaaagtttggctgagaaatttgctgttaatctgataggttttcctttataggttatctgatgctttttcctcacaactcttaagattctttccttcatcttgactttagataacctcatgactatgtgcctaggtgatgatctttttgcaatgaatttcccaggtgttctttgagcttcttatatttgaatgtctagatctctaaaaaggccagggaagtttgccttgattattccctcaactatgttttccaaacttttagatttctcttcttcctcgggatcaccaattattcttaggtttggtcacttaacataatcccagacttggaggctttgttcattttttcttttcctttgtcggattgggttaatttgaaagccttgtcttcgagtcctaaagttctttcttatacttgttcagttctattgctgagactttctagtgcattttgcatttctctgagtccttgatttccagaagttatgatttttttatttatgctatctatttcactggagatttttccattcatatcccatgtctttttttttttcaaattcatctaagttgggcatcacctttctcagatgcctccttgactggcttaatagtagatcttctaaattctttctctggcagtccagagattttgccttggttgggatccattgctggtgagctagtgtgatctttcaggggtgttaaagaacgttgttttgtcatattaccagaattgtttttctggttccttcccatttgagtagactatgtcagagggaagatctatgactcaaaggctgaagttcaaattcttttgtcccacagggtggtcccttgatgtactgctcttccctttcccctagggatggggccttctgagagctgaactgcagtgattggtatttttcttcagaatcttgccacccagaagagctaccaggcccttggctggtactagagatagtatgcaaagagtcctgtgatgtgatccatcttctgatctgtcagccatggattccagcacctactccagtggaggtagcaggggagtgaagtggactctgtgaggatcctttggttgtatttttgtttagtgtgctgattttgtgttggttggcctccagcgaggaagtgccactttcaagagcacatcagctctggttgtatagggaggatcaggcgctgggtggggccatagagctcccaagagattatgtcctttgtcttcagctaccagggcaggtagggaaaaaaacatcaggtgaggtcagggttaggcatgtctgaactcaagactctccttggatggggattgttgtggctgctgtggggcagagggtatggttccccagcccctccataagccaatggagttatgttccctggggaattatggctgtctctgctgtgtcacactggtcaccagggaagtggggtaaagccagcagccacaggcttcactcagctcccacgcagcccacaaccccaaaggctggtcttggtctcattcccaccagcactgagtttatttgcaggcagctggtgagctgggctgagaacttgccccaggctacaagcctcccagctgagaaagcaagttgactcacagttcctcaaatgacctatggggcctgcagcagcagaccacctcgttcaaagggtctgtggattctctcagcttttctggtatattcttgtggtagttcttggagcaaaagttcatgatgtcagtctccacatgctactctgtccatccaagtgggagctgcaagttagtcctgcctgctatcctccattttcctgggctatcaaaatgactgtttttgataaatttaaggtggctggataaaacacaagatgctgagataagttttaatttcagacagttttagtataagtgtgttccttgaaatctttgaaacatactgatactgtatttttatctgccaactttaacaatcctacatacattggacaatagtcacaagacagtggatattgaaagaagaaaaggcaatgaggtgaggccaatgataatcccagttttaaggttagaggcaactatggactatggtttcaaggtcagggaacccaaacagagtccagaagtctaaaacagaagaaagcctgcagacaaaaattagagttcagagaggctaactttagaggacagaataccacagagcagaaagatacatggaaacagagttctgcaaatttgcatagggatcaccttgagtccttggttgtaattgcttaggataaaaattcataaggcaggaaaaacaaaaaatgctggaaaaagaacaataatcaagggactataagtcaaataattccaagagttcacacagggccagagtttccactagtcagagtggaaaggtctcaattagtacataggacttccagtaaagaccccagaaagatgaagatttaaaagtagagataaagtaacactagactaaattctactccatatgtacccaaaaaagatacacagcaagccatgaaagaatcaaatttataaaggagtaacttaactgctggccagaacaaagacccacactgaacaccaaaatatttattattcctcaacaatgtaacattcataatgtcaaaaatccaattaaaaattcttagacatccaaagcaggaaaatatgatattttaccaaaagaaaaaacagtccatagaaacagactgaaaaatgacagagatgatggaattagcaggcaaagacttttaaaaagctattgtaaatatgctcaatgtccacaaagttgtaacattaaaatgaaaaagtgagaaattaaaaatatttttaaaaagaagcacttccaaagctgagatatactgtttgaaaaattatgaatatacttaaaaacaaatataaatataacaacagaattaaaaatattagtgcattcaaaaacttgtcaataaaactatctaaacatatccacagagagaaaaaaagagtagaaaaaaagagattcagtgacatgtaggacaatatcaaacaactaatatacaaccaactgaatacccagaaggagagaagttgtgggggtacagaaaaaaatcatttgaataaattatcactaaacttttccaaacttgataaaaatgtaaatatgtggatccaagaagatcagcaaaccctaaggagatacaaacagacaaaaagacatacagccatctcataattaaattgctaaaaatcagtcataaatagaaagtattaaaatcagccagagcaaaaaggaacacagcacatagggaaaaacagctaggaatgtcccctgatttcttgtcagcaaaatgaaaaccataagacaatgaaggaacaactttaacatgattaaaagtaacaactctcaactttgaatactgtactcatcaacaacaaaaatattcttacaaataaaggtgtattagtcaattttcacactgctgataaagacatatccaagacggggaagaaaaagaggtttaatggactcacagttccacatgcctggggatgcctcacaatcatggtggaaggcaaggaggagcaagttatgtttcacatggatggtggcaggcaacgagagagaacttgtgcggggctactctcattttaaaaccatcagatctcaggagacccattcactatcacaagaacagcaagggaaagacctgtccccataattcaattgtctcccaccgggttcctcccacaacatgtgggaattagaggagctacaagataagatttgggtggggacacagagccaaaccatatcattccacccccagcccctcccattggttgatttcaaaacgaatcatgccttccccacagtccctcaaagtctcaactcacatcagcattaactcaaaagtccacagtctgaagtctcatctgagacaaggcaagccccttccatctatgagcctgtaaaatcaaaagcaagttagtactgtcctagatacaatgtgtatacagacattgggtaaatatagccactccaaatgggagaaattggcccatttgggccaattggcccaaaacaaaggggctacaggccccatgcaagccctaaatccagtggggcagtcaaatcttaaagctccaaaatgatctgtgactctgactcacatctaggtcacgctgatgcaaaaggtaggttcccattctcttgggcagatccacctctgtggctttgcagggtatagccccctcctggctgctttcatgggctggcattgagtgtctgcagctttttcaggtgcacagtgcaagatgtcaatggttctaccattctggggtctggaggatggtggccctcttttcacagctccactaggcagtgcctctgtagggattctgtgtgggagcgctgatcccacatttctcttttgtactgccctagcagaggttctcaatcagagccctgcccctgcagcaaatttttgccttggcatccagatattttctgttttttttttttttttttttttttttgagatggagtttcgctcttgttgcccaggctggagtgcaatggcgcaatctcggctgaccacaacctctgcctcctgggttcaagtgattctcttcctgcctcggcctccccagtatttgggattacaggcatgcgccactatgcccagctaattttttgtatttttagtagagatggggtttctccatgttggtcaggctggtctcgaagacccgatctcaggtgatctgcccacctcagcctcccaaagtgctaggattatagacgtgagccacagagcctggccacatccaggtatcttcatacctgttctgaaatctcaacagaggttcccaaacctcaattcgtgacttctgtccaccctcaggctcaacaccatgtgaaagctgccaaggcttggggcttcaaccctctgaatcaacagcctgagctgtaccttggctgtttttagtcacagctggagtggccatgacacagggtaccaagtctctaggctacacacagcacagggacccagggcccagtccacaaaatcactttttcctcctaggcccctgggcctgtgatgggaagggctaacatgaagacctctgacatgccctggagacattttccccattgtcttggggattgacattcagctcctggttacttatgcaaatttctgcagcagcttgactttctcctaagaaaatgggattttcttttctattgcattgtcaggctgcaaattttccaaatgtttttgctctgcttcccttataaaactgaatgcctttaaaagcacccaagtcacatcttgaattctttgctgcttagaaatttcttcccccagataccctaaatcatctctctcaagttcaaagttccagaaatctctaaggcaggggcaaaatgttgccagtctcttcgctaaaacattacaagagtcacctttgttccagatcccaacaagttcctcatgtccatttgtccatatagttgtccacattctgggaaaagccattcaacaaatctttagaaggttccaaactttcccacatttttctgtcttcttctgagccctccaaactgttccaactcctgcctgttacccagctccaaagttgcttccacattttcaggtatcttttcagcagtgccttactctactcgtaccagtttactgtattagtccatttttatgccactgataaagacatacccaagactgggaaaaaaaagaggtttaatagactcacagttccacatggctggggatgcctcacaatcaaggcagaaggcaagaaggatcaagtcatgtctcatatggatgatggcagacagagagagagcttgtgcaggacaactcccatttttaaaattataagctctcatgagacccattcactatcacaagaacaccatgggaaagacccacccccataattcaatcctctcccactgggagctacaggatgagatttgggtggggacacagagccaaaccgcatcaaaaaggtaactaaagactctcaaaaaaataaaatctgaatttatcacaaccaaactaatactataaaaaatgctagagttcttcaggtagaaagaaccttttaccagatataaactcagatccacacaagaaataaagaataataaaactgtaaatacatgggtaaatatagacaatgtcttctcatattttaatttcctcaaaagattaattgggaggtagtacttccagaatgtcagaatacccaactgtttcccaaaaaccaataatactggataaatgtgtcaaaaacagtaattccagggctctggaaaccaacaacatgcatacaacaaactgagcagtgtttattcaagaaaagctactgaaacttgaataagaaaaataggagtttgtggtgttttagcctgggaatgctaccatacacccctcccctagctccatcaaaattggaattctaccagaggaagataacatcggaaaaacagatgctttactgctaaagaaagctgatttgattttaagcagactgtgggaaaacgacatgccattggaaaatagtttacaaccaaattggaaaatcatatcatagctaatctaaaattgcaatctaattgtggcaagcaacagaccagcagagaagcaagaactttaaaagtaatacccaggtaattagaaagtcatagtgagccttgagaaactcctacatgctcttttggcctgaaaagctgtgttcatttacaaggttatgcacatgattgggagacaacagggaggcaactagccagccacacatccctgaatgtacataagacctgcatatgaacgaaagagacatgagagaacataaaataaaagatgggtcaaattcataaactgcctaaactttatatgcattccccaatccaaacacagattcataggcgaggtatacaatccttacttatgttataaattgagtacaaccactgactaattaatatctgacctttaaattatgctaaccccgtaagaaatcataattttttaaaatatctgagcacagatattagtgaccacataccacaagagataattagtacaggcatgtcacttaacaaaccaacaagtagcactaaaaacaactgcggcaagattaaaatacagagtggctagattatcttaaatgtccagtttttagcaaaaaaacaaattaaacatgcggagagaaaaaagaaatatgactatattcagggaaaaagagcaaccagtagaaactgtatttgaggccgggcgcggtggctcacgcctgtaatcccagcactttgggaggccgaggcgggtggatcacgaggtcaggagatcgagaccatcccggctaaaacggtgagaccccgtctctactaaaaatacaaaaaattagccgggcgtagtggcgggcacctgtagtcccagctacttgggaggctgaggcaggagaatggtgtgaacccgggaggcggagcttgcagtgagccgagatcccgccactgcactccagcctgggtgacagagcgagactccatctcaaaaaaaaaaaaaaaaaaaaaaaaagaaactgtatttgaggggcaaagatgttggatttagtagataaagctaaagcagctgttataaacatgttcaaagaactaaaagaaaccacatttcaaaaactaaagtatgacaatagtggtccatacataggctatcagtagatatataaattacttaaaaggggaaaatggaaattttgaagacaaaaaatataactgaaataaaaatttactgaggtgggaagggcttaatatcagttttgagataggagaagaaagaatgcacaaacttgaagaaaaacaagagtaaacaaaaaagaaaataacgaagaaaaagaaacagagcctcagagacctgtgggaagccataaatatatgcataatggcttcccaatagagaataaagagaaagtgaaagaaaaatacttagagataagaaagctaaaaaattcctaactttgatttaaaaagttaatttagacatccaagaagctcaacaaactcaaagtaggatagacaaaagacgtccgcacctagtaacattatattcaaacttttgaaagccaaagacaatgaaaacacattgaaaacagcaacagaataatttgtcacttatagggatcagaaataaaccatgatcaacagctaacttctcaacagaaacaataaatttcaaaaagtaatgtgataacattcaaaatgccaaaggaaaaaaaaagtaaaccgagacttaaatcagcaaaactatccttcaataatgaaaatgaaatttttagagaatatgactgggatatagagtatctcaaggaaccaaaaactcctcaaactaataaataattttagcaaggtcatggaataaaaggttaatgtacaaaagtcaaccatcaccccgtatactagcatttaaaagtctcagaatttgagactttttaaaaaatgccatttataaaaattccaaaaaataactcacttatgtataagcctaacaaagtatatatacaatctgcttgtggaaaactacaaaatactgaaaaaacaaatcaaggaagatctacataaacagaaaatatactatacatattgactagaagattcaatagtgttataattaggctgtgaaacacagtttgcctgcccttgatatagatgcaaaaaattctcaaaatattagcaatacaaagacaccagcaatatgaaaagaattacacagcatgaccatgtgagattaattccacaaaagcaaaattgactaaagataaagacaattaatttactatattaatagaataaaagtcaaaaatatagaatcatttcaatggacacaaaacattatttgaaaaaaatcaaatactcctttaggattaaaaactacataaactagaaatacaaaggatctttctcaacctgacaaagagcagctatgaaaaatctacagctaatgttaaacttaatggtaaaagactgaatgctttccactaaaattgtaaacagggcaacaatattcacttttatcacttctattaaatgttatactgaggtgctagctaatatgataagacaatataaatgaattgaattaatccatattggaagagaggaagtgaaactatattttcaatcaacatggtcctatatgtaggatatattaagaaatccacattaccataaaactagagctaataaattagttcggctaggtcacagcaaataggataaatatggaaatattaattaaatttctatatatcggcaatgacccactcacatatgaaattaagaaaacaattccattcacaaaagcctcaaaaagaaaaaaaaatgtaggattaaatttaataaaggaagtgcaagtcttgcataccacaaaacattgctgagagaaatgaaggtgtaaatggagaggcattctatgttcgtgttcaatattgttaagacggcaatttgcctaaaagtaatctataacatcaaaataatctctatcaaaataaaagcaagtgtttaaatggtatttgtgtgtgtgtgtgcttgcaggccattgcagaaattgatgaggttttttctaatgaaatgcaaaagatgcaaaatagcccaagtcattttgaaaaacaataacaaactttgagtacttatacttctaactcaaaacttactataattacacagtaatcaaagtactgtggcacttgcaaaagatacataaaccaaagatacagaattggaagtccagaagtaaatccttaacatttatggttcattgattttcaacaaaggtgctgagacaattcaatgggaggaaaaaaatagtctttttaacaaatggtgccaaaataattagatacccacatgtaaaaagatgaatttagacctctaccttataccatacacaaaattaagtcaaagtgaataacatacctaaatatacgagctgaaactgtcaaacttttagaagaatacctaggagaatgatccctatgacctttcgttaagaaaagagttctcagatacaatgccctgagcatgatctgtaaataataataacaataccagtatacatcatcaacatactatatcaaagagaagtagtgaaagtgggcattcttatcttgttctggttctcaaggggaacgcttctagcttttgcccattcagtatgatgttggctgtgggtttgtcacagatggcacttattattttgacatatgttctcctaatctttagttgtcatagatggctcttattatgttgaagcatgttccttggatgcctagaactcccactattattgtatggttatctaagtctctttgtagatttctaagaacttgttttatgagtctggctgatccagtgttgggaggatatatatttgagacagttaagtcttcttgttgaattgaaccctttatcattatgtaatgtccttctttgtcctttttgatcactgtttgtttgaagtctgttttctctgaaattggaatagcaacccctgctctttaagaatattttcttttttatgggaaacagggggtcagtcttgctctgtcacccaggctggagtgcagtaatgtgatcatggctcactgcaacccccgcctcctgggttgaagcaattctcatgcctcagccaccagaatggctgagattacaggtgtgtgccaccacacccaattaacatttatatttttagtagagatggggtttcgccatgttggtcaggctggtcttgcactcctgacctcaagtgatccacccaccacagcctcccaaagttctgggattacaggcgtgagccaccatgcccatacaactactggcgtcttttgttttttatttgcatggtagattttttctccatccctttactctaagtgtgtcatcgtatgtgagatggatctctagaagacagcatacatttgggtcttgcttctctatccaacttactactctgtgcctttttagtgggatttaaactgtttatgttcaaagttaatgttgacatgtgctggtttcatcctgtcatcatgatgttagctggttgttatgtagacttgattgtgtagttgctttttagtgtcagtgagctatgtaattaaatgtgtttttttggtggctggtaacagtctttcatttccttgtttagcactcccttaatgacctcttataaggcagttctgataataatgaaatctcttaacattgcttattggaaaaagattgtatttctccttaacttatgaagcttagtttggctggatatggagttcttgttggaatttattttctttaaggatgctgaatataggcccccaatgtattctgggttgtaggatttctgctaaaaggttcacatgtgtgtgcacattaccaaagcaggagggtatggcaaaagcaggcacgtgcacgctggcaaagcagttgggataaagcaatatagttctgggacagcatttaagccttggttctcactctaagcctttcacagaaaggtaaataatggcaaagcagcaatttagatctagactagcagttaaattccaatattcaatctgaatcttcctcagatcaagaaatgatgacagagcagtgagattgttccagtgttgtcttgagttctggtggtcactaaaagtcttctccagaatggaaagcaataataggccagcatttaggtttcaatccttataagtaaagatctcacactatcaaaaagcacctacaaaaggtgaaagaggtggctgtctcctcaaacttataggcatcaacataaagatacaagcattgtgaaacctcaggaaaatatgacactaccaaaagaaacctagaaaacttcagcaatagagtcagaaaaattgatgatctatgaaatatctgatacatgagtcaaaataacccacttaaagaagttcaggaagttgcagaaaaatatgaatagaaaattaaataaaaattgaaaaacaatttcggaaaaaaatatttaacagaaaaatagtaatagtttttataatgcaatagagttcttgaaaataaagaatataattatgaacagaaaaactcattataaagcttcaaaagcaaacttgttcaaaaaggaaagaattactgagctggaagacagcacatatgaaattacccaatcagagaagaaaaagaaaaaaaaaaactaacctctgcataattggaacccccaaaggaaaggagaaataaaagagcttagcaagcatgtttaagggccaggtgcagtggctcacacctgtaatcccagcactttgggaggccaaggtgggcggatcactagctcaggagttcaagaccagcatggccaatgtagtgaaaccctgtctgtactaaaaatacaaaaattagctgggcttggtggcacccgcctgtaatcccagctactcaggaggctgagccaggagaatcgcttgaacctgggaagcagaggttgcagtgagtgaagattgagccactgcactctagcctgggtgacagagtgagactccatctcaaaaaaaaaaaaaaaagcaagcaagcaagcaagcaagcaagcaagcatatttaagaaaataatgactgaaaatttcccagatctggagaaagagggcagcatccagatacaggaagctcagaggtcaccagtcaaattcagtcctatgaggaattccccaaggtacatcagaatcaacttagtaaatatcaaacacacacacacacacacacacacacacacacacacacacaaattgttcaaaacatcaagaaaaaagaaacatatcacattcaagcgttctctaatatggctttcagtgggcttttaggagaaaccctgcaggccaggaaaaaagtagaatgctaaattcaaagtgctgaaggtaaaaaacaacaacaacaacaacaaaaaaaaactcttagccaagaatactgtactcaacaaagctattcttaaaacacaaagaacagattaagacattacactaccagaccaacaaaagttgagagaattcatccacagcagacctgtcacaagaaatgctaaagaaatagatactaatatgtaacaataaaacatctgaagctataaaactcactggtaaatacaagaagccacatttgtaatactctaattctataattgtgcaagtaaaccatttatatgtcaagtataaagactagaagacaaaagtattaaagacaatgataactatagtaattggttaagagataggcaatataaaaataggtaaattgaaacatcaaaaaattaaaatgtggggggaaaataattttgttttcagtactttcctttgcaatcaatgttaagttgatatcagctttaaaaaatctgtaataactaaaagattttttttgtaatcttcatgtgaacctcaaggcaaaaacccacaatagatacactaagcaacatagaatgaaaacattctactaaagaaactcacttaactacaaaagaagacagcaagagatgaataaaagaaagggtctataaaataaccaaaaaccaagtaacaaaatggcaattgtaaacccttacctatcaataataaccttgaatgcaaatagattatattatccaattaaaagaaggagtaactacatgatttaaaaacaggatccaactatatgctgtctatctgaaactcaatttgcctataaagatatgtacagactgaaagcgaagggttggaaaaagatatcccatggaaaacaaacaaacaaaaaagcaggagacattatacttacgtcacataaaatagatgttaagtaagaaatgattttaaaaagataaggaagactattacataataatactcagaataataaaggtgtcaatatggcaagagaatataataattggaaatatatatgcacccaacaatgaaagactcaaatgtataaaacaaagactaatagactaaaagacagagattgattgtaatacagtaatagtaggaaacatcaacactctactttcagcaatagacagatcatccagacagaaaatcaacactgaaacattggagttaaactgcactccagaccaaatggaccaaacagacatctatggaacattccatccaacagcagaaggaaacacatttttctcaatagcacatagaacattattcagtgtagaccatatattaggtcataaaacaagtattttaaatttttaaaaataaaaattatatcaactatcttttctgaccacaatggaatagaattagaaatcaataactgaaggaatattggaaactggacaaatttatagaaattaaaccatgtgctcctgaacaagtgggtcaatgaaagaaattcaaaagaaaacttaaaaattccttaagacaaatgaaaatgaaaacacaacataccaaagcctatgggatacagcaaaagtagttctaagagtgatgtttatagcaataaacacatacatcaaaaaagcagaaaatcttaaataacctaatgatgcatctcaaggagccagaaatgcaagaacaaatcaaacccaaaattagtagaaggaaagaagtaataaacatcacagcagaaataaatgaaattgaacctaaagaaataaagaattaattaaacaagttggagtttttttttaaaaaagatgcatgaaattgacaaacctctagctatactaagaaaaagagaagacccaaataattcagagacaaaaaaggaaacattataactgatatcacagaaatacaaaggatcataagagactaatatgaaaaactatacaccaacaaaatgcaaaacctagaagaagtggatagaagcctaacggattgaactatgaagaaacggaaaacctaaaaagaccaaaaaagagctatgagatcgaagcagtaatgaaaaggttttatcaaagaaaagtgcaggacctgatgttactgcatcagcaacaatgctcaatgttaccaaacatttacaaaaaattaatatgaattctacttaatcttttaaaaataattgaagaggagagaatatttccacattcattctaagaggccagcattacactggtaacaaaaccagacaaagatagaacaacaagaacaacaacaacaacagaaaactacaggctaataacactgatgacggtaaatttaaaaaccttcaacaaaatactagtaaaccaaattcaacaatacagcaaaaaggtaatacagctatagcttctgtctacatgaggcttatattctattgggggatacaagaagtaaacaagtaataataaacacataatttcatagtgcaagtgctgtaaagaaaggtaaatgttatcaaatattattggcccaactaatttaagtctagaaatagtcaagagacttaaaatgccttataacatgtgactataaacaaaatttctttttcttctgttggaaaaacagcaaatatgatttagttcagaattttaagaacgatgtgagcagaaagaatagtgggagatatgttcatcaagtgaaagtaaaaggcagcacttctaatgatcctggcattgtctccggctctgtgaggaaaagaaaataaggtccctggggtcagataaggagctcagaataagctcctagctgagttctctggatatggttaattccataggatattttttaccatgtcacaagaattgtgggctttttcagacatgttagtatgtcttctatcaaatattttccagagaggcaaatatatttcctgcattatctacagttgtgttccacataattaagatgtgtgacaactgtctatatttatgtgttccaagaaggcagtctgccagttaatgcaagaaagaaaatgtcatttgttctacattctgcctaccgtaccacccaaatcagctgctcctggctctgctcaagacctagagatccatggggaagaatacatggtggttaggtggcctatactttctgccgtggctgagcaagtttacaaaatctttccagcgaataccaggaaaaagcatgttttccagcaacctcaagtcatgcaagcgcttttcttacaggacaaacctagtctttctgaaaccatctgtaccatagcagagtgcagggcatcagttattttagcgggcctgttctagactactacctgaaagcagctaaggtttgaagtcaaatctgtaccaattaaaattattcctgttttctttataattggacaattataaccttttccaccacctagcctcaagcagtttcaggtctttaattttcttcatccctcaaatagaactaactagtaatatttgtactcccttattatcttagatgatttttatctttctagagtagataactatgtttcagtaactttagtgttgattccagtctattattgtcacctataaggtagaatgcaaactatacaattgcaccaagatgtttagaaatacctagtccctctggacaagaactgaatattgggagatgccaacaggtcatatggagaacctggatgggaacttgctaagacaaacatgcttcaagtagacgtcaaagtcattgactgctttcatatctcttgtacatattttcctccacaccacaccctctcaagtaattatgttggctagaggcctgaattatttaagtgaggcatattttcagtgagagaagttatttctgtgacctatatatgtctagatccaacatacatagctttgaaacaatctgaagttatacaattgcctgtctcccatatgaagcttgtgggcttcacaaacataatacattttctcaagttctcttaaaacaagattggtcttgttcttcaagttatctcagcagctcaaatgaatgtgaacaataaactggaatcctggtgctagaaacctaaagctttttattttacccaagaccaaacctgtatgtcttcgaggggaggaatataaagaaagagaagtttgccattagagccttccctttttctatctgctcatagttgacagttctcagccagtttctttgaaactatgctgttattctatcccaactgtgaaaaaaagaaccataacctagaattattttttgtcccactcctgtagactctaaattaccaactggtaaatgtcatcaagtcagtcacaagccagtagaaaagaaagagaaaactgccactaagcaacagaagatatttctatttctactttgttttctagactactagtgaccaatagtgtgaaattcaagcaaggccaaagggatatcatctcaagcaaggtggaatacttatgcaccccttagaatccaaacaagtaatctaccttatgagatgcctaaccacctcaaagttggaaacaagtcctacatgccagctgtcacttactaagtcttcatttatgtcatctaaaaatcaactatttgaatcacctagtcttctgtaggggagtaatgttgaattagaaacagtttgatcaatatttgcggttatctagccgcatgtgtaagtccctacaatgaactacaaggttgggaattaaaggaaaaaaaaaccccactgccctaaacatctcttcttcacactgcctgagtatgccactttccctcttctcaggtgtgaaatgctaccaaatcaaggttcgtttgggttaacaagcctatttttataggtaaataactctaaaaggattcatttaacaattaagtcctttatggagagtacacaggctgccttagtcaaattacttctctcctaaactctagttgatatatccccagagtaatgagtactttaatagcagaaacatagaaaaaagaagagcaatttcagaatatgaggagagggctttaagtaaagacatgcttgggtaggacattaaaatggaggaaagatgtttagagcagccaaaagggatgggataagtgaagggaaaagaaaggtaaagatgacaaaagatagatacttcaaaaattgtttctggactctccatactcccagttttcagtgtaatactgcctcttgactatttagatatgctattatcttttgggccatatctttaaaataccataagctgggaggtttataaacaacagacatttctttctcacagatcacgaggctggaagtcagaggtcaggctgccaacatggtcagttgttaagggccctattccagatttcagatggacgacttctccctgtcctttcacctcgcagaaagagagcacaagaactttctggagccccttcaataaggacactaattccatttgtgaggtctatacccttataacctaattacttcccagaggcccaattcctaatactaccacgttagagactaggatttcaacatatgaatatgggggagacagaaacatttggtccattacgagtaggcatcagttaacagattacacaaaagataaaactcaaaagcagccttactctcttcatacaccatatcaacagatcatctcaaaatccatcaattatgtgatttaaaaatctccatatattggccaggtgtggtggttcaagcctgtaatcctagcactttgggaggctgaggcaggtggacagcttgagcgcaggagtttgagaccagcctgggcaacatgacaaaaaccccatctctacaaaaaatagaaaaattaactgggcacctgtagtcccagctactcaggaggctgaggtgggaggatcacctgaatccagaaggccaaggctgcagtgaatcatgattgcaccacagtactcctgcctggatgtcagagtaaggcactgtctcaaaacatttccatgtatctttatatttcaaattttggtaacagctaaaaggaataaaatccttttctgatgattttcaatggccttactgatttaaaaagagaaaaagtaagtctaaaggcatgagtttgtaaaggtgggttgtcagtatatgagtcaaatgtggggcattatcttaattcactgtctcacgcttatattactcagaccattattctagtcagccaaggccaaaaatgaacatattttcagactcaagtacaaaccatctttccttgaatattctagaggtttgacaggcctcgaaagaagtacctaagtgtatgggaggcctaagaaaatcagtttttaccagattcaagaatcaaatgaaggcattttaactctattacctactctgcagttcaaatacatttgccaagagattatttatagttgtggacaatgaaaatatgatctgtaaactgcctgtggtgagagttgctttaagaatcacaaacctgggtggagggagccgtatggtgacgctcagcagcacagtgacacagcaggctgagagagaactccagagacttctgttttcatagcagctctgcccccacagccttgccacataaccctgggcagtcttttaacctgttccagatgtactttcctccatagtttgtgagttaatcagcagctcttggaaagaaatactaatttaaataatttgtaaacaaaaggttttatagagtacagcaaacaataaatagcaaggctttaaactcttgatagcatgagtgaatcagctccaaatcacttatcctaccctatcaaaggtaatcattgggcagtttttaacaagatactcacatctactgtccagccaagccttcccagccactctcagttgtaaaacttaaagatcttaaaattggtatctgagtctgtatcccaaacccaccaaacaagtagagtctggaatttacaacttttcctagggcctgatgacgacggttgcttagtggcttccatgcacactagacctggagccaatgagacccagattcaacagctgactagaaacccatattcccgccaagggaagtagaaaactttcaaaaccagtttcaaacgggagggaactagtttcaaaacggatgtttcaggattggggcattaatttcctctttagtttctggagagaggccagaaaaaacattttaaagacaatataaccttcatcatgtatggccagtatagaagaatcacctttcaatctaccattttgacctaaaccctgatctatgtcagtccttcatctgcctttccatgtcctcaactttgaggctgggtcaattgctgcttcttgtatccctattttttctacaatttatagcactctgggaaaaaaatctgagtaaaaacaatattctgtaattgttacggcctacctggattttcccactgtgatccagcaccctgatttcaatcatcagtcaagtttcctcagtccaaattcccatctatgtcaacggccagagattctagtggtggttatttttaatcatgacttcgtgaaaatgatgaagaaattctctgaaaatgcctttatttgcattgatggaatgaaaactatgtttatgcaatttattgtatagctaacttgagcatactcacatgcaattattatagtgggaagtttggaatacacattcagctcctctacattaagaggttaatgaaaaccttttgccagcatgtcaaaagtggtattagttctaattcagcatggtgtttttctccgtgccacatgtaggccctgcttaccctcctttgtgggccccatgctgtgtttattcatagtagtctaggctgaacaaacatgttttctttttaatcacagtacttatttacagtctctttatgaaaactgcttagagttaaatttaaatactagctttaataattgtatttccagataggatttttttcccctcaacacactctggagaatatctgccactaattagtccttatattgtttacttgatgcagtagttcatctcccacacctgagtgccccatgcaattggtgccgggcatgagttctgcatatttctgtgatggaagccatgttcaactctgatccctttaaagaagaaaaaatagcttctggaatgaggttacaagctaacaatgtgctcactcactttgtgaaaaaatggacacaataacttcatctctataccacaattaatatccctctcatctatagcaactcagggaagctactacttaaccactgcctacccaaaatcataatggctaacatcaacccaggaacctctctttctcctactattctgttcctcgttaaacatccaagcttcattcattcattcaaaaaatatttgagcacttattatatgccagacactgggctaggcactagtttaattaaaaagtttaccactactttactccatctagatgtgacccaactatgcccttgaatatctgcaccagataatatcacctgtgaattgtctgcaaacttcagacttggtgttttagattgctggtcactctcaggaggttcaggcttcaactttccagtttcagaccaagcttgttccttccttgagggagttcaaggcatggtcttgattaaagacttccagaaagagtccatacaattgagaggtaagagcagctttaaccaaaaccttggggctgcttacctactcaaggtttcttcaagtgtgtcattctttctgactcaggttgttataacaccctctcatcttcctttaaccctccagctccccatctgttctccagaggaaaaactctttttctctctacatctatctccatggctttaggtcaaaccactgacatcacagctacctaccaccgggagcccatattgccctcagcaataagcaattctggcatccctgatgcttttccctcaagacttgatttatcattcttgcttcgggtcaaaactgctgaagttataacttctttacaatccttaagcttaacttagctctatccctaagtaactctcacctctttcctctctttagtttgcactatactcactaaaaatatcttagattttctatccttccttctaatgtttgctgaactacaaagagaaatggtttgcacagtgtccagaaagagaacacaaaaggggaacatttataaacacatacttagccccatccagggaagagcatgccctgaagagccaacaagcctggtttagtgtttatggtctgcttatattgttgaaaaccccaagctatagtgtctttaagatgccagccatctagataataccacttatgctagtggttcctattacaagcttaccaagcagtctcctagttttagcttgcctgtccacatatcttttcccacactgtacacatcacctgacacaagtctatcgatttgcttagaagctaaatttcttattataaatgtatacattattctggttagttcactctttaacaagttttattagtgtacctcatcttctagaacagatcacttctgaaaaatataaacactcaaatttctagacatgaatttttttgtccccaacttcagacttttggagactcataaaggtatatagttaactgggttaaatgcagaacttggctacatccctgggagtgccttaactcacacctgagttctttatgtcttattttcaacctctatttccacaaaattataaactcacagacatacatatatgcatatatatcaatgatttttctgttaatttcattggaacatattacttaaactgtctgagttcatcttttttaaaattccttgtaatgactaatattagcatctctaaatttaaatcctgagtcattttacttggccaatgtttgatacatttgtgaaagtactggtttcttcgcaaagtctgggatgtccccaaattttaagccaagaattcctctgaggaacccattaacattttattaaggaaaaatcaatgcaatgtttcctgctagcaagcataatatatttctaactacctcttctttattttcttaaatctcctgtctttccagattattgcttgaaaactatctttcttcaaggcatcatcaattgagttagattggcctacctcagcaggcatccttatattgggcttgtctttcttagctgttgatttttctctgaacctactatatttattgaattctttctacataatgtcttttggaaaccttttatccataaagattccagccctttgctgtcttttaggaattgccaaaattaaagatttttgtgcttgtataattcatgtttgactattccagtctttgctttacttttaaatacttctacttcctccctcccccttgttatctcactggtctaatctgtgcagtaagatgaaggcataaatgtctgaattatagatttaggtgtagatagaaatacctactgatatcacagcatgccttattcattgtttctgtggacacacacacaaacacacaaacacacacacacacacacacacacacacaatgaaaggtaaagagtatcaaagaagtccctgaaggtagctgcacctatgctggacttttaagaagattgtttttactgcatttgggtagactacatcaaagttctgtcagattacctcttagtaggccaggtgcagtggctcatgcctggaatcctaacagtttgggaggacaaggcaggaggaatgcttgaggctaggaattcgagaccagcctgggcaacacaatgagaccccatctctacaaaaaatacaaaaattagctggacatagtggcacgtgcacacagtctcagctgcttgggtggctgaggcaggaggattgcttcagcccaggggcggaggcggtaatgagccatgattaaaccactgcactctggcctgggtgacagagtgagagccaagctggaaatggcacaatcataactcatggctcattttttctaaaaaaaaaagaaaagaaaagaaaagaaaaaacaaacaaaaaacaattcttagtagatttctaatcagtctctgtaatgtacatagaattatttttaaaacacaactttggccttgaaatatgatggtgatttcaatccttcctgtctccctttcatgcagaaagtgaaactcttgagataagaacaaacatccagccttttcatatctctggaccccttactttctctgaagcttcttctcccagagcctgtttactccatatattccagctctaaaaagctactagctgctagtattcccaaatggccttgggcccctgcacatgttgttccctccaagtgtaattccctttcctcctatcttaccctgcaattttattcacttcttcaaagcatattttgtgtcccttcctctatttaagactttccagaatctacagtgactatagtccttattttgtgttcccattatactttatagacacttctaccaggacctttgtaactattttattcatttgcttacattatgcatctcattttaagtctctaagccccttgaagggtccatatgttcatgcaaatcacattttactcagaattcatgaaagtgtctttgaatatagatatacagtactccacaaaattgtatttgttaataccacaaggcaaacagtccactgattcacaagcatgaatttggaatttgttttggagcaatgtagaatttccctattctttaacaatctttgttcaattctttcagggcttaaaattactcattagtaaagttattagtagaaactatgaatgtgatcaagaagcaaggtatacccagctggtataggagactcatgatccaataataaccctgtgttctcaccagcagagcaggtaatgcagtacagtcaatatactaacagataacactcatgcacacacacacacatgctttctaggctccccattcagatttgtttataagatgacatcaaagtgcaaaaagttaagcatatcatatttatcaaagtagaatttctaaattttagcaaaaatcatctcatctagcaaagagatatttgactggaaatacatgttaaaattttccagcagtccgaatctctggagatctagtaataaagaggatcaagaataatgtattaatattataaaacattcttgaggtggtcagaaatcatgaaaactttgcccaacattactttttgcgtaatatggttgggttttctgcccccaccccaatctcgtcttaaattggaatccccataatacccatgtgacaaggaagaaaccaagtggaggtaattgaatcatgggggcattttcccccatgctgttctcattatagtgaatgagttatcatgagatctgttttttttttttggttttttttttttttttttgagacagagtctcgctctgtcgcccaggctggagtgcagtggcatgatcttcgctcattgcaagccacgcctcctggattcacaccattctcctgcctcagcctcccgagtagctgggaccacaggcacctgccaccaggcctggctaattttttgtatcttccctacttcactaggcacttctccttcctgccaccttctgaagaaggtggcttgcttgccctttggcttccaccataattgtgagtttcctgaggcctccccagccacacttaactgtgagtcaattgaacctctttcctttataaattactccatctcaggcagttctttatagcagtatgaaaatgggctaatagagcaaattggtaccacagagagttgagtgctgcaataaaaaaacctgaaaatctggaaccaactttggaactggataacaggcagagattggaacacgttggagggctcagaagaagacaggaagatgtggaaaagttgggaactttctaagagacttgttgaatggctttgaccaaaatgttgataatgatatggacaaagaaatcccggctgaagtggtctcagatggagatgagaaacttgttgggaactggaatgaaggtgactcttgctatgctgtagcaaatagactggtggcattttgtcccttccctagagatctgtgaaactttgaacttgagagagctaatttagcatccctggtagaagaaatttctaagcagcgaagtattcaagaggtaacttgagggctcttgaaagcattaagttttatgcattcacaaagatatggttcgcaactggaacttatatctaaaagggaagcagagcataagttccaaaacttcacagctaacaatgcaatagaaaagaaaaacccattttctgaggagaaattcaagctggctacagaaatttacgtaagtaaagaaaagccaaatgttcatcaccaagacaatgggataaatgtctccagggcatgccagaggtcttcacggcccctcccatcactggcctagagatctaagaggaaaaaaattgtttcatgggctgggcccagggccttgctgctttgcacattctcaggacttggtgccctgcatcccagccatggctaaaaggggccaatgtacagctcaagccattgcttcagagggtgtaagccctaagccttggtggcttacacatggtgttgggcttgcaggtgcacaaaagtcaagaattgaagtctgggaacctccatctagatttcagaggatatatggaaacacgtggttgtccaggcagaagtttgctgcaggggtggcgccctcatggagaatctctgctagagcaatgcaaatgggaaatgtaggatcagagcccacgcacagagtcaccaatgggacactgcctagtggagatgtaagaagagagccaccatcctccagacaccagagtagtagatccactgacagcttgcaccacgtgcctggaaaagacagagatgctggatgccagcctgtgaaagcagctgggagtgggactgtaccctacaaagccataggggaagagctgcccaagaccataggagcccacttcttgcatcagtgtgacctggatatgaaacatggaatcaaaggaaatcattttggagctttaagatttaatcactgccctgctgggtttcagacttgcatggggcctgtagcccctttgttttggccaatttctcccccttgaaatgggtatattttcccaatgcctgtactcctattttatctaggaagtagctaacttgcttttgattttacaggctcacaggcagaaggaacttgccatgtctcaggtgagactttggacttggacttttcggttaatgctggaataaagtaagacttgggggactgttaggaaggcatgattgatcttgaaatgtgaaaaggacatgagatttggcaggggccaggggcaaaatgatatggttaggctttacggccccatccaaatctcatcatgaaatgtaatccccataatccccttgtgtcaagggagagaccaggtggaggtaattgaatgggggcagttttccccatgctgttctcatgatagtgagtgagttctcatgagagctgtcggttttataagggcctcttcccctcttcactaggcacttctccttccggtcccctgtgaaaaaagtgccttgcttcccttttgccttccatgattgtaagtttcctgaggcctccccagccatgctgcactgtgagtccgttaaacctcttccctttataaattactgagtttggggcagttctttatagaagtatgaaaatgaactaatacactcattatctgttaaattcaagtttataactttttgtaaccagttcttattttctttgaaattacagtaataatgtgatttgggggagtaaggatagcgttatttctctctttgattcccccagaaatagaagtgtacttgtatattatattcaatatatatatatacttactaaatacataaaatatatcattatcactttctgtttcataaatatagatgaatatctttatagatattcatgattctaagtgtaatataaacagactctccaataaaaactcttaactggaaaagaacaccaaataagggacaaaataatctaaattaaaatatactattttttcaattttacatttctttttaaatatcagaattttatcagtattttgtatagtttattcagcttagatcagatcatatccttttctttttggggtttattaaattatttaggctttcctcatatttatggcttttgcctcccaaaatgggatatttccacaatgttctttctctctctttgctttcttccttattaaaaattatctcagactcagatttctcaaagaactaaaactagaactatcattcaatccaacaattccactactgggtatctacccaaagggaaataatttattatatcaaaaacacacttgcactcatacatttaccacagcactattcacaatagcaaagatacggaatcaacctaaatgtagccatcagtggaggggtaaatacacacacacacacacacacacacacacacacacacaccctgtaatactactcagccatgtaaaagaatggaatcacgtcttttgcagcaatgtgaacagaactggaagctgttatcctcagggaaataactcagaacccaaataccacatgttctgacttataagtgggagctaagcaaagcaatggatgcacatgaacatacagagtggaataacagctattggagactacatggtggaagggggataagagttgaataattatctattgagtacaacgtttccattcaggtgatggttgtactgaaagcccagacaataccataacacgatatatgcatgtgagaaacctaatttgtacctcatcaatatataaaaattgtaaaaattaaaaagtcaaaaacaattttcaaaatgtcaagaaattatctcagactcaaattaatcattgtattgccaaaaacaaatgttggaatgtttgtagagaaaaggcaacacttgcacattcttggtaggaatgtaaattagtatatccactgtggagaacagttcggaggtttcttaaaaaacaaaaagtagagctaccatatcattcagcaaatccactgctaggtatgtacccaaaagaaagataatcagtatatcaaagagatatctgcactcccatgtttgttgcagctctgttcacaatagccaagatttggaagcaactgaactgtccatcaacagacgaatggggccgggcacagtgactcacgcctgtagtcccagcacttcagggggccgaggcaggtggatcacttgaggtcatgagtttgagaccagcctggccaacatggtgaaaccccacctctactaaaaatagaaaaattagccaggcatagtggcacacgcttgtaatcccagcaactcaggaggctggggcaggagaatcccttgaacccagaaggtggagtttgcagtgagccaagatcacaccactgcactctagcctgggtgacagaacaacactctgactcaaaaaaaaaaaaaaaaaaaaaagatgaataaagaaaatgtggtaattatacacaatggagtactattcagccatagaaaactgagatccagtcatttgcaacaacatggatggaactgaaggtcactgtattaagtgaaatatgccaggcacagagagataaatgtcacatattctcacttatttgtgggatctaaaaatcaaagcaattgaactcatggagatagacagtagaaggatggttaccagaggctaggaagggtagcctctgggggactacagggaaggtggggatggttaacagttacaaaaaaaaaggttagaaagaatgaataagacataatatttcataacacatcagagggatatagtcaataataatttaattgtacatttgaaaataagtaaaagggtatatttggattgtttgtaacacaaaggataaatggttgaaaggatagataccccattttccatgatgtgattattacacattgcatgcctatatcaaaatatctcttatattccataagtatatatgcctagtgtataccaataaaaatataattaaatttaaaaagtaattttattgccaaaagtatattcctaacattttttttttgagcagagtcttgctctgtcactcaggctggagaacagtggcataatcttggctcactgaaacccccacctccctggcacctgcaatcctcccacctcagccttcctagtagctggaaccacaggtgtccaccaccatgcccagctaatataaattgaatacataaaattagctattactacatgataaagacaatgtttgtcagtccccaaagggaatatgtctattgggaccatataccttataaagaattccttaattcaatgtaaatataaatacaaaaatgaattttattagatagtttaaagacgcatttcaagtaagaatgaatttaatacaaggaattaatgcttacacaactaatggaagggctgtgggacaaaggtcaagggaaaagactgctgggtcttaggggattaagaaactatagacatctgaagaaattgccactaaggaactcagctgacggtagcactgaatcagagatttgccatctgcccaccattgccagaaaataaaatgatctcccttccatgttccaaatgccacactagtaccttttattgaaataacctaactttagaatcctactagtcaggacttattaccattaacaatcaaaggaccagaaaccaatgcaagacctttcctctgagctatctggaagagtattgcctaataaaatatttatattttaattgtagagatgaggtagtgctttttttaatggctacaaattctttgacacttctctcatcaacaggtggggtctatatcctctctttatcctagattcttggagtcctgtggctgctttgaaaatacactgccagaagtaaaggcatgtgagttgtgcaataaggccaaaaagacaacagagcttccatgtggctttcttggatcttttggtctcaagactccatcttagaatccagccacaatattgagagaagccctagttgacagtctcagctaagcccagttttgagtcatcttaccctgggcatcaaacatgcaagtaatgaagcctttatatatgtgcccccactgcttcattcaccctcactatatgaagcctgagacatcctggggcagagccaagccatcccttcagtaccgtgtctgagttcctgatccatggaattggtaagtattataaaatggttattttacactactaagtttggggtggtttataattcaacagtagttactgaaacaactcctgaaaaaatgagagaaaaaaaattgaggttgatggagacttagaagctatggaattcatcctgagtatgcctatttgaaagttatcccaatgacctgacagatgaggtgtatgtacgaagctatacaattaggcttacaattatctgttacaaatctgaagtattcgtcttcctccattttatcccttctttatataatcttaactctggaacctaaaacttcagagagagcagatttgggtcttctttacccattcccatatcttcacccaaattacacagatgaagggcaatttgaatctttaacaattacagtattcacagaaactgcacaactttatcacattaattaactctcatccacatactcccagaggagaaggagcaaaaattccaattacagaatccatttactgaacaaaactgaatttcttgtaagtggagcctatcatatttttctaaacccttcccttgagtttgacaattcacagttataacactttcttatgactaagtttctgttctgttacttcatctcactttatatacagatgttctctttgattttcatctctttgttccttttgctctgccatcaaaactgacagttataataagcttttatgtgacattgtatgttttgagcacctagggattatacccatttattattctgttcagcattcattagcaccatcactcttttctctatatatttgagtgtccagtgtgtataaactgtagcttggtcctaaagcaaaagataaaagtacagaaagacctagtctcttaattgtaaggtacttactttctgataaagataggaatgtcataaatataatagcattaatttttaaatagaaaaacacaagaaaagaaaaagctgatataattttgaaacaataaaaatagttttgtaacttaggctcacctgtaggacatagtaggacctctgtggcttcaattaatagtccaagaagaattgagcttgagttcccatttgctttcccacgactttattgagcaactaacttgtgtcaattagcatactcagaagtttacatttttatttaactgactcagtacttaagttgccactttcaattttgggaagtgatccaatagatcaaataaagacaataaatttgagagtttgttcaagataaaggaggagtatcaaggaacctgccccaatagtcacataggttcttttctattttccctaagtgtcagccggcttgagaaataaaggcacagagtacaaaagagaaaaattttaaagctgggtatccaggggagacatcacatgtcggtaggttccgtgatgccccacaagctgcaaaaaccagcaagattttattagggactttcaaaaggggagggagtgtgcgaataggtgtgggtcacagacatcaagtactttacaaggtaatagaatatcacaaggcaaatggaggcagggcaagatcacagatcacaggaccacaggaccggggcgaaattaaaattgccaatgaagtttcgggcaccattgtcactgataacatcttatcaggagacagggttttgagagcaaccagtctgaccaaaatttgttaggtgggaatttcctcttcctaataagcctgggagcactatgggagactagggtctatttcacccctacagcctcgaccatagaagatgggcacacctaggtggggcgtttatagacctatacccccaggcgcgtattctgtttcccagggatgttccttgctgagaaaaagaattcagcgatatttctcccatttgcttttgaaagaagagaaatatggctctgttccgcccggctcaccggcagtcagagtttaaggttatctctcttattccctgaacaactgctgttatcctgttcttttttcaaggtgcccagatttcatatttgttcaaacacacatgctctacaatttgtgcagttaatgcaattatcacgtggtcctgaggtgacatacatcttcctcagctgacaggattaagagattaaagtaaagacaggcatagaaaatcacaagggtattgattggggaagtgataagtgtccatgaaatcttcacaatttatgtttagagactgcagtaaagacaggcataagaaattataaaagtattaatttggggaactaataaatgtccatgaaatcttcacaatctatgttcttctcaaacggagagactgactgaagccatggcagaagaacatggattgacttcccgcaacagaggagggttggttcaaaggcaaacaatttcggagtgatagtggtacacttacaggcaataaatcaattaaaagcagaatcttagtccaatgtactgaccaccaactatgtagtagaaactgtgttaaacctggagataaaagatggttaggccgggagtggtggctcacgtctataatcctaacactttgggaggctgaggcgagtggatcacctgaggtcagcagttcgagaccagcctgaccaacatggcaaaaccctgtctctgttaaaaaatacaaaattagctaggcttggtcgcgcatgcctgtaatccaagctactccggtgcctgaagtaagagaatcgcttgaacccaggaggcggaggttgcagtgagtcaagatcgcaccattgcactccagcctgggcaataagagtgaaactccgtctcaaaaaaagaaaaaagagaaaaaaaaaaaaaaagatggttaatccatagcccctacctacaaagttatagataccacgagatagatataaatatatataaggtcaagtagatatgcaaaaacagaaaagtctagccccagaagacagataaataggacaggtacaaaatgtattcaatgacccaaagaactgtgaaatagtttaggatagtactgcattctctaaaagtaaactagctaatttaaaacccaaatggatactaataacatatgtgaatatcaaaaacattatgtttaacaaaataataaaggtataaattagtaaatgctatattatttcacttataagaagttcaagaatgggaaaactaatctttgttgaaggaagtcataacagtggttcttctgtagagtatcgactggaaagaagtacaaatgaattttctcgggtgatgaaatattttgtttgagtgttggttacaaagccgtatgtatttgtcaaaacacattaaattgttcatgcaaggtctcaatctattagtctctgctttatgcttggcttctcagcctctcagttctaggcgcattaccttagcaaattctgtaagggtaagtacagtagagaatattttattcatcacagtgtatttcccttctatccaataactgagtccctcaagtcttgaaggacatgatagctcagcaataccttcgaaatatccactttgtactactattatcattgtatcctactgtttctattttgttttatcaagatacaagctagtccatcccatctagaagtagaggtctaaaatagattttttaatgttttgccaactgaggagccatatggaaaaagataaaattgaatctgttcttcacactacacacctgtgtgaatatcaagtggatcagaataacaaatcacataagcagtaggaaaaaacatggatgaattcctttataaaccaagggtagatgaaactttcctttgactctctaaagtattataaaacaacttgataaatttgactacgtaaaaattaaaaacacaaaaagttacattataaaacaccatataaaagggaaaaagtaataatgaactgataaaaatgtttgtaatttatatgttttcatatccctaataaagcactcctaataattaaaaagaaaatgatcaagcctgtaatacaaaaaattgttgagtaatatgaagagagaccacaaaagaaaaaattaggaagacattaaatatatatacacacacatatgcatgtgtgtatgatgttcgctctcatttataagtaggaaaatggcgatcgtaaactgtattatgtagatttaattttaatactaatattagcatttttatttttaaactatgttatgtttctgtttttaaagtatgttgtaggataaagtgaataattatgttaatgccaataaaaacaagaatttttaatttgagaaaaaaataagtacaagaaaaataaaatttcacatcttaatattgaattggaaatattaaggtaaaaatattttatctctttcattttaaaaatacatattgcctgtttctgtctactagaaaggcctagaatctgtggcgactcaggagcaatgagcacccctagcataaaggttatggtctctaatactaatgctctacttaaaggaaaaataagtactcaagagagtttttcaatctgaaatgaaaggaagttaattagtaacataagagcatataaaagtataaaactcactggtaaaattaagtatgtagtcaaattcagaatactgtgatactctaatgatagtgtataaattacttgtggctccagtataaaggctagaggaaaaaaattaaaaatatagcaataataatatatttatggatacacaatataaaaagatgtaaattgtgacatcaaaagcatacaatgagggggaagggtaaagttttggtatgtaattactattcctatgaacttaaaatagttagatagtaagacattttatgtaagtcttttataaccacaaaacaaaaacctatagtagatatatgaaagataaagagaaaggaatcaaaggaaaccactacagaaaatcatcaaatcaaaaggaagaaaagcaagacagtaagaaaggaacaaaaaatccacaaaatagaaaataattaacgaacaataataaattcttacgtatcaataattaccttcaatgtatatggattaaattatccaatcaaaagatatggagtggccaaaccgattaaaaaaaacacacacacaaaaactacatgctgtctacaagagactcacttctgcttcaagaacacacacagactgaaagtttagagatggaaaacaacatcccttgcaaacagaaaaagagcagcggcagctatacttatatcagacaaaatatgctttaaggtaaaaagtgtaaaaacaataaaaaaggacatttaataatgataaaagcattgattctttaaggagatataacaattataaataatatgcaccaatcatagcacctaaatatataaagtacatattaatcgatctgaagggagaaattgacagtgatacaataatagtagtaggcttgaataccctacttctaataatgaatagatcatccagacagaaaatctgtaagaaaatactagacttgagaaacactttggaacaaatagacctaacagacatatacaaaacattccatccaacagcaacagaataaacattattctcaagcacacagaaaacattctccaggctaagtcatatgttagaccacaaaataagccttagccaatctaagaaaactcaaattatatcaagtaacttttctgaccaaaatagtatgaaatcagaagtcaataacaggaatattttgggaaagttcacaaatatatggaaattacataacacattcctgtataatcaacggggaagagaagaaattaagagaaaaatttaaaaataataccttgagacaaacaaaactaaaaacataacataccaaacttgtggattctgcaaacgcagttctaagagggaagtttatagcaataaacacctacatgaagaaaaagaaagatgtcaaataggctgggcacagtggctcatgcctgtaatcccagcactttgggaggccgaggcaggcggatcatgaagtcaggagatcgagaccatcctggctatcatggtgaaaccccatctctactaaaaatacaaaaaattagcccggcatagtgacaggtgcctgtagtcccagctactcaggaggctgaggcagacgaatggcgtgaacccaggaggcagagcttgcagtgagcccagattgggccactgcactccagcctgggcaacagagcgagactccacctcaaaaaaaaaaaaaaaaaaacaagatgtcaaataaacaacctaacattacacttcaagtaagtagtaaaagaagaataaactaagcttgaatttaatagaaagaaggaaataacaaagatcagaaaagaaaaaatgaaatagaaactagaaaaacattagaaaagatcaatgaaaccaacagttttttaaaaacataacctacactgacaaatcatcagctaaagactcaaataaataaaattagaaatgaaagatgacataaccactgatatcacaaaaatacaaaaatcatgagactactatgaacaagtatatgccaactaattagataacctagaagagatgaatgttctagaaacatacaaactaccaagattgactcatgaaaaaatagaaaatttaagtaaacctaaaattggtaagaatattaaattagtaaataagcactctcaacaaaaagaacctcgagatcagatggcttcaatgatccaccaaatatttaaagaattaatgtcaatacctctaaacttcgaaaacaattgtagaagaaggagcacttacaaacacattttatgagaccagcataacctgccactaataccagataaggacaatataagaaaagaaaattacaagccaatatccaaaattaaaagccagttaaggaaaacaataagaaaagaaaattacaagccagtatttctgatgaacatagttgcaaaatactacatcaaaccaagttcaacaatgcgttaaaaggatcatatgccacgatcaagtgatatttgttcctgggttacaaggatgtttcaacatacgcaaatcaataaatgtgttatgccacattaacagaataaaggacaaaaattatataatcacctcaaaagacacagaaaaagcatttgactaaatccaacaacatttcacgatcttaaaactttcacaaattagatatacaaggaatgttcctcaacacagtaaaggccatatactacaagcccaagagctaacatcatattcaatgaaaaaaaaaaggaatcttatcctctaagaataagaaaaagacgaagatgccaactcttgtcacttttactgaacatagtattggaagtcctggtcagatacattagtcaagaaacgaaaaaaatgggcatccaaattggacaggatgaaataaaattgtctgtttgcagataacataattttaaatatatatatatgaagaatttcaccaaaaacctgttagaataaagatattcagtaaagctgcaggatacaaaatcagcaaacaaaaatcaccatacaacaatgagctatctcacaattaaatttttaaaaatcccatttacagttgcattaaaaagaaaaaaatacctagaaataaatttaacccatccatgagttgaacactacaaaatattaatgaaagaaattgaagaagacacaaaaaattgaaggacatctcatgttcatggattagaagactcaatgttgtctaaatgtctatactacccacagtgatctatagattcaatgcaatccctatcaaaatttcaaaggcatattttacaaaaataaaaaataccttgctcgattggggaagttctcctggataatatcctgcagagtgttttccaacttggttccattctccctgtcattttcaggtacaacaatcagatgtagatttggtcttttcacatagtcccatatttcttggaggctttgctcgtttctttttattcttttttctctaaacttcccttctcacttcatttcattcatttcgtcttccatcactgataccctttcttccacttgatcacatcggctcctgaggcttctgcattcttcacgtagttctcgagccttggctttcagctcattcagctcctttaaggacttctctgtgttgtttattctggttatgcattcgtctaattttttttcaaagtttttaacttctttgccattggtttgaatttcctcctgtagctcggagtaatttcatcatctgaagccttcttctctcagctcgtcaaagtcattttccgtccagctttgttccgttgctggtgaggagctgtgttcctttggaggaggagaggtactctgctttttagagtttccagtttttctgctctgttttttccccatctttgagaacttccccaatctagcaaggcaggccaaaattcagattcaggaaatacagagtaagtcacaaagatactccttgagaagagtaactccaagacacataattgtcagattcaccaaagttgaaatgaaggaaaaaatgttaagggcagccagagagaaaggtcgggttacccacaaagggaagcccatcagactaacagctgatctctcagcaggaactctgcaagccagaagagagtgggggccaatactcaacattcttaaagaaaagaattttcaaaccagaatttcatatccagccaaactaagcttcataagtgaaggagaaataaaatcctttacagacaagcaaatgctgagagattttgtcaccaccaggcctgccctaaaagatctcctgaaggaagcactaaacatggaaaggaacaactggcaccagccactgcaaaaacatgccaaaatgtaaagaccatcaaggctaggaagaaactgcatcaactaacgagcaaaataaccagctaacatcataatgacaggaccaaatacacacaaaacaatattaactttaaatgtaaatgggctaaaggctccaattaaaagacacagactggcaaatcggataaagagtcaagaaccatcagtgggctgtattcaggaaacccatctcacatgcagagacacacataggctcaaaataaagggatagaggaagatctaccaagcaaatggaaaacaaaaaaaaggcaggggttgcaatcctagtctctgataaaacagactttaaaccaacaaagatcaaaagagacaaagatggccattacataatggtaaagggatcaattcaacaagaagagctaactatcctaaatatacatccacccaatacaggagcacccagattcataaagcaaatccttagtgacctacaaagagacttagattcccacacaataataatgggagactttaacaccccactgtcaacattagacagatcaatgagacagaaagttatcaaggatatccaggaattgaactcagctctgcaccaagcggacctaatagacatctacagaactctccaccccaaatcaacagaatatacatttttttcaccaccacaccacacctactccaaaattgaccacatagttggaagtaaagctctcctcagcaaatgtaaaagaacagaaattttaacaaactctctctcagaccacagtgcaatcaaactagaactcaggaataagaaactcactcaaaaccactcaattgcatggaaactgaacaacctgctcctgaatgactactgggtacataacgaaatgaaggcagaaataaagatgttctttgaaaccaacgagaacaaagacacaacataccagcatctctgggacacattcaaagcagtgtgtagagggaaatttatagcactaaatacccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaacccttcaaaaaattaatgaatccaggagctggttttttgaaaagatcaacaaaatcaataaactgctagcaagactaataaagaagaaaagagagaagaatcaaatagatgcaataaaaaatgataaaggggatatcaccaccgatcccacagaaatacaaactaccatcagagaatactacaaacacctccacgcaaataaactagaaaatctagaagaaatggataaattcctagacacatacaaccttcccaagactaaaccaggaagaagttgaagctctgaatagaccaataacaggttctgaaattgtggcaataatcaatagcttaccaaccaaaaaaagtccaggaccagatggattcacagccgaattcaaccagaggtacaaggaggagctggtaccattccttctgaaactattccaatccatagaaaaagagggaatcctccctaactcattttatgaggccagcatcatcctgataccaaagcctggtagacacacaacaaaaaagagaattttagaccaatatccttgatgaacattgatgcaaaaatcctcagtaaaacactggcaaaccaaatccagcagcacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgtaggaaaggcctttgacaaaatcaaacccttcatgctaaaaactctcaataaattaggtactgatgggacgtatctcaaaataataagagctatctatgacaaacccacagccaatatcatactgaatgggcaaaaactggaagcattccctttgaaaacgggcacgagacagggatgccctctctcaccacacctattcaacatagtgttggaagttctggccagggcaattaggaagcagaaggaaataaagggcattcaattaggaaaataagtcaaattgtccctgtttgcagatgacatgattgtatatctggaaaaccccatagtctcagcccaaaatctccttaagatgctaagcaaattcagcaaagtctcaggatacaaaatcaatgtataaaaatcacaagcattcttatacactaataacacacaaacagccaaatcatgagtgaactcccattcacaattgcttcaaagagaataaaataactaggaatccaacttacaagggatgtgaaggacctcttcaaggagaactacaaaccactgctcaatgaaataaaagaggatacaaacaaatggaagaacatttcatgctcatgggtgggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagccggaggcatcgtgctacctgacttcaaactatactacaaggctacagtcaccaaaacagcatagtactggtatcaaaacagagatatagatcaatggaacagaatagaaccctcagaaataatgctgcatatctacaaccatctgatctttgacaaacctgacaaaaacgagcaatggagaaaggattccctagttaaaaatggtgctgggaaaactggctagccatatgtagaaagctgaaactggatccctcccttacactttatacaaaaattaattcaagatggattaaagacttacatgttacacctaaaaccataaaaaccctagaagaaaacctaggcactaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaatttttgcaacctactcatctgacaaagggctaatatccagaatctacaatgaactcaaacaaatttacaagaagaaaacaaacaaccccatcaaaaagtgggcgaaggatatgaacagacacttctcaaaagaagacatttatgcagccaaaagacacatgaaaaaatgctcatcatcagtggccatcagagaaatgcaaatcaaaaccacaatgagataccatctcacagcagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatcttgaactagaaataccatttgacccagccatcccattactgggtatatacccaaaggattataaatcatgctgttataaagacacacgcaaatgtatgtttattgcggcactattcacaatagcaaagacttggaaccaaaccaaatttccaacaatgatagactgcattaagaaaatgtggcacgtatacaccagggaatactatgcagccataaaaaatgaagagttcatgttctttgtagggacatggatgaagctggaagccatcattctcagcaaactatcacaaggacaaaaaaccaaataccgcatgttctcactcacaggtgggaattgaacaatgagaacacatggacacaggaaggggaatatcacactccggggactgttgttgggtggggggacgggggagggatagcattaggagatatacctaatgctaaatgacgagttactgggtgcagcacaccaacatggcacatgtatacatatgtaactaacctgcacattgtgcacatgtaccctaaaacttaaagtataaaaataataaaataaaataaatatcatggtaaaattcatatggaatcacaaaagtctctgagtagctaaagcaatcttgagcaagaggaataaagctgggagcatcaaatttcctgatttcaaatcatatcacaaatatgtgataatcaaaacaatatagtattggcataaaaacagatacatacagcagtggaacagaataaaaagtgcagaaataaactcacacatatatggtcaacttatctttgacaaaggcatcaagaatatacaacagagagaacaccgtctcttcaatagacagtgtgtgttaaactgtttatccacatgcagaaaaatagtaattgaatccttaaattacaccatgcacagaaatcaactcaccaatgaattgaagatttaaatataatacctgaaactgtaaaactcctataagaaaatctgagagaaaagctccatcacattagattttttggatagaatataaaaaacacagggaacaaaagcaaaaattaacaagtgggactacatcaaaccaaaatatttctgcactcataacaaccaacaaaatgaaaatgccacccacagaatgagagaaaagatttggaaaccctatatgcaatgaaaggttactatctaaactatatgaagaactcatacaagtcaatagtacaaaaataaacaacatggtggaaaattagtcaaagtagacatttttccaaggacaagatacaaatggtcaataggtatatgaaaaagtgttcaacgtcactaattatcagggaaattcaaatcaaaatcacaagatatcaactcacacgttaggatcgctattatgaaaaagaaatcaaaaaataagtgttggtgaggatatggaaaaaagaaaacccttgtgcagtgttggtggaaatgtaaattggtacagccactatggaaaacagtataaagtttcctcaaataagtacaattaccatatgatccagaaatcccatttctgatgatacatttaagaaaataaatcattatctgaaagagaaatctgcactctcgtactcagtgaagaattatccacaatgtccaagatatggaaacaacctaagtccatggacagataaatggataaatacatacatacacacacacacacacacacacacacacgcacacggaacattattcagcctttaaaaagaagaaaattctgccatttgcaataacacggatgtacctgagaatactgtgctaaatgaaataaataaaccaacaaagaaagacaaatactgcattacttcacttatatgtggaatctaaaaacatcaatctcatagaaacaaagactagaaggatagttaacagggtataggggatggcaacaatagagagatgttgctcaaaggatgtagacttgcaatggtaagttctggatacctaagtacagcatggtgattagaattaatagtaatatattgtatacttaaaatttactaagagagtaaaccttaagtattctcgtcatgaaaagtaactacgtgaggtgacagatatgttaattagcttgattgtggtaatcatttcacaatgtatatgtatgtcaaaacatgtacaaaataatatgccttgaatgtatacaatttttacatgtcatttgtacctcagtgaagtttggggaaaaaagatagttaagaaacataacaaccatttgcaatgaggagaacttattaaagaaaatcaagtctgaaaagatatttttgaaatgactgaaggtatgttaacatgcatttgctattctacattactagggaattattgttaactttgttaggtgtaataatggctttgtaattatgtgagaaaatacttgtttagaaaatatatatatacatatatgtatattttttttgtaaacatacacaattttttgtatctctgtgtatatatatatgtgtgtgtatatagatacatatacatatatatatatacagaagtggatttaaatgacataatgtatttgtcagtgttaagtaatgcctttgtctcattacatcattttgaataaattgaaattttaaactgtcttaaattatgtattagtgactaatataattctttttgtgacttgtttatttatagaactcaatttctagctaatcttgaggtgcgatagttcatagttctgaataattcatttataggagacaggaaattggtttacaattaactcctgttaggatgtgtggcattatcattttctatattgcattcccattaaataatttatctccaataactgacttttatccatgaatcactgtataatggaaaccctttcgtcatccaagaaaaggggcagtgcagtacgctatgtttaaactaataaatcgacagttttcaatggatggaatcgaaactctgagataaatggaaatagtccccaaggacagtcaaatgtgactttctgcagatggctgcacagaatgacacttcataaaacatcatttctctgctaagctgcacagcatctatggtgcttcaaacatattgtttatctcatcaaagggagcaggttctaaaggtaagaactgaacaagtgccactgctgaggaaacagagcagatggcccatctatgatggtctgccttcacttgatgagagtctgctccaatctcaaacaggcccattgccaattaaaagaggtcttggctgagggatctttactttcctgtgacacataattcacttgtccattttctcagactcctgcccaccaacaagtttcatcactgccccctccagaaattaagaggttcgttatgaccagttgtgtgatacgtcccattgatacttgcttgtaaatgtctggatgtcacccaaacttctcactttagtgtccggctgcattttattttaagactctttctagcttaattgctaacaaggacatgtgtccatgctttgtaaaagaacttcaagttcatggattaaacgtaagaaaatttattggacttccttctaccacaaaatacactttattaactactcttttcaaacaactttagcattgaaacattttaagttagtcaaaatcatttaagttttcataaaaacagataaaaacattttatgattagaaggcatatgtgaactttcaaacttcaggatcctgaactccaatgttgtttaaggaagacgatcctaagtctgaagaagactatcccaatcaaatgtccagtaccaagaaccacgtatctatattgggatattttctgtttgcgagaggatcctaagaccaggttagtcagatcttgacagttactagacaacctgagttacctagagcaagttttgagctacatggcaaaggaatgggccaaaaccatgccacatctggagataaacctgagggaaatagtaaaccaggagagaacagtggtttggatacacagagtggagaagaagtgaggtatacatacagaattaaatcagctctaaaatttaatcaaaaggagattctgatcctgtgttgctttaaaattttggtatcttttttctcgaagttggggcactttcctaccacatcccaaattttttagattgtaaaccatctggaaacacaatccatgtgtgttttgttcaccattctatttctagtgcttagcacagtgctttatatctagtgcccaataaatttttttgaataggaatgtctgggacattgtaggaattgaatatttattctttcaaagaagaaatggacattgattaatattctaagcatgatgaagttggagcattgttatcttcctttgttcagaagaaacagtaggatttctctgtaaaattcagaaccctgaggctgggattaactcatcctgtaacccaggcattgaaaccatttcaatttattactgagcgcaaatctcaagaaaatcaagaggttttttttcttataagggtatctaaaatattctgatccggaatgttaaaatatttttgacttggtattaagaattagatcttaaaacttctttctcctgtattcataacagccctcaaaattttctccctgcctccaggcttgcttcactgcacttcatccttcacacgcctccagtgtaaccttgctaaaactcagatttgatcaggtcacttactcttccattccaaagttttctgtggtttataattcatgccttaccatggcagtaaacacccttcacccttctatttttttcagtctcatccagaccaggcctctttacccacagatgccatccatgtgcccacgctccagccattctacatattttaccaatcctgaacccctacataccttttccttgctcttctgttttacatgttcctttctttatttttggcttggcagtatccaactcttctgtcaaaatctagtttaaatgctaccttccctgggaagcttttcttgactcatccagatagaattaatcataccttctgtgttcctatacctttaatatagagtgtaacagatgggagtgaaagttttggagtcagaaagatgtactttccaattctggttttcctgcttaccatgacctgagcacaacacttaaggtccctgagcctcatatttttcacctataaaatgggtataatatcgacatattacaattgcaatgaagattaactgtgatcattataaagaatgtttagcatagtttggctagtcaaaactcaaagaaagatacttacattatttttatcatcttattattatttcatcatgtatgaccatctgatttttggataatgtcatacctgcataatctactagattttgagtcattaagataggtctatcatattcacattttatttatagtgcctaacacagtgtctgacttactgacagtgtcatctcagtgcttatcaagtccattagcctttgatacaagatttcctaggcttttttgtgaaaatgtaccaatatatatctgttgatttgtgtatgaaatcatgtgtattactttaacaatataaatacatgtgatgctatcaattgttctttgtaattttgccacaataatccttgaaaaagcagaaacagaagccaatttctttttacctcttcttcactcgaaagtataaaattaacatgacttcaaaaggcttacagaaaataatatattaagtctcatctaacctgtatttccagcaacatacctaccagaggtagcttgagctgaaattgcactgaaactcctaagtgattttgttcacccaattcaattgctatttaggtatctgctatccccagttcattgggaaagcagtatggaacaagataacacaaaaagctttctttctagttcaattaaaataaacagtgacatatgtcctgctgaaataacaactaaacaatagcattaaaagcacctaagatatctaaatgggacaagtatttgtgatgtcatttcataattctgactacatcatgtgggtgcctccagtccccaggaaattaacccccactttgccaccaatgtaatcattttggctttgtgactacccagctaaaactcttccatatttgcacatttctggcttaaagcatatagtccaaacttttagcgtggcacaaaaaaaccttgctgaaatcccaaccatacctatttttatagcctcgcttatcacatcttattcataccgcttatattccagccacatgaaaattgtctccttgaacttccagtatcaacttcacatgtaaaaagcttagaagtcttcactcctgttcttaaaacaagtaaaacctgcaaaaactgaaaatcaatgacttttcttggaaccctcagagaactgagattgcagagccaactgtaaccctgaaatctagagaaataagctcattcagggaaacacagctgagatcctcttatctgaagcagaaacccactggagccataaactgaaaggaacacttaaatggtaattttggtgaactgctgaaaggtgagggtgaaccatcattatagagggacaaacccctggaggctggaggcttggggcattaggggacgtattttcacaggttttactatccagaaacccagcaagatcttcactgttaactgtgatcattataaaaaatgtttagcatggggcttgactagtaaaaactcagagaaaggtatttacattacttttatcattttattattgcattatttatcacaatctgattgatattacagataaggtcatgcctgcataattcactaggtattgtaaagtctagaacaacaaacaaaatttataaagaattataattgagatgctgggaagagagaaaatgaaaatataaatagttaattaaaacaagaaaaacagaaaaagaggaagtaaaagaaacaagaaagggaatgaatagaaggcagatatgtgcacagtagatattaactcaactaaattaattatcactttaaatatgaatggtctaaatacaccaaccaattaaaaatggagactgtcggccaggcgcggtggctcacgcctgtaatcccagaactttgggaggctgaggcgggcagatcatgaggtcaggagatccagagcatcctggctaacacggtgaaacccagtctctactaaaaatacaaaaaattagcccggcgttgtggcgggcgcctgtagtcccagctacttgggaggctgaagcaggagaatggcgtgaacccgggaggcggagcatgcagtgccgagatcgcgccactgcactccagcctgggcgacagagcgagactccgtctcaaaaagaaaaaaaaaaaaaaaaaaaaaggagactgtcagagtggataaacaaaataaaatccaacctcgtaatgtttacaagaaaactacattaagtacaaagacacagataaattaaaaataaagagatggagaaagatataccttgctaacactaatcaaaaaaagctggaggtatattaatttctgaaaaagctagcttcagaaaaagtaagactactatggaaaagaaaagcattaaataatgataaagtgatcaattctttaaaacggcataataatcctaactgaagacaacagcaaaacacatgaggccagaactgatagaactgcaaggagaaatagaggaatccactgttatagtcagaaacttttaacatacctctgtaggtaatagatcaaacaggcagaatataacagtaaggatacagatgaccttaacaacgctatcaatcaacttgttcttttgacatttatagaatacttcatccaataacagcataatacacatttttcttcagctcatagtcaccaatatattctgggtcataaaacacatcttaacaaatatggaagaatagataccctacaaagtttgtttaaagaccacaatggaattaaacaagagataataataaaaagatagctggaaaatcccccaatatttgcaaatttaacagtagacttctaaataacacaagggttaaagtagcaagataaattttaaaaataattttaacatgaaaatgaaaattaaacttataccaatatctgtgggatttagcaaaaacagttcctaaaggtaaaataatagcattaaatatacttattagaagagaagaaaggtataaaatcagtaatttaatattttttccatgagaaactggggaaatggtaatttaagtataagcaagcaaattaaattaaaaacagaaaaataatagaaaaaaatcaatgaaaccaaaaactggttctttaaaaagatcaataaaatttataaccaaaaaaaggaaagacacaaatgaacaaggtcagaaaggaggattcatctctactgatcctatgatattaaaaggataataaaagaatactatgaacaacactatgcccacaagttggataacttagataaaattagaccaattcctcgaaagacagaaactactaaagctcatacaaggagaaacagataacttgaaaagttccatgtctattaaagaaattgtatcaataatcaataaaattcaaaaaggaaagcaccaagcccacatagtttactatgaattctgccaaacatttaatgacgaaataatatcaattcttcatttttttttctgaaaaatagcagagggaaggcttcctaatttatctcataaggccaacatggctctaatatcaaaaccagatttaaaaaatcacaagatagaaaactacagatcaataacttctataagctagacacaaaatcctcaataaaatattagcaaattgaatctaataatgtataatgataataattaaacaccacaaccaagtagagttcattccagttatgcaagcatgattcaacattcaaaaattagtgtaaccatcacatcaacaggctaaggaagaaaaatcatatgattatatcaactgacctcaaaaaaggcatgacaaaatccaacatccatttatgcttttaaaaaaagaacacagtgtgaaggttaatattaggtgttgacttgattggattaaggaatgcctagatggtgtgtgaatcagtaggttgggagaaaaaaatttcccctcaatgtgggtgttcaccatccaacccacactgcctactactgaggtgagaacaaagcaggccaaagagggggcatattcattgttgaacttctctctctctctttctggagggggatgctttttctccttctgcccttggacatcagactccaggttctttggcctttgtactctggaacttgcatcagtggcttcccagggactctcaagcctttggcctcagactgaggggctgcactgttggcttccctggttttgagggtttgaggctaggacaaacccatgttactggattttctcattccacagcttacagatggcctattgtgggacttcacctttgtaatcatgtgagccaattctcctcaataaactccctttcgtgtgtgtgtgtgtgtgtgtgtgtgtcctgcttgttctgtccttctgactgtggagccccaactattacactcacaacttaggaatatagaagagaacattctcagcttgataaagaacacctacacaaaacctacaaccaaacttatacttaatgatgacagatttgatgtttaccccaccaagatcaggaatgaggcaagggcatccgatcccaccactcctgttcaatatctttttttgtttgttttgaacaactagatttatttcaagccattttaaatgcttatcaaatcaactgtaaaatgttaaaacctgggagattttattcaccagctgaaggactcatcattactatcttaaaaaacagcaatgaataagcaaattagaaacaaacaaaaaccgaacacaacaaaacaaacagcaaattgctcaatatcttaatagaagccctagcttgtgcaatataatcagagaaaaatataaacagatacatattggaaggggagaaatgaaactgttattatttgacatgattatctatgtagaaaaacccccaaagaatctacaaggagagaaggctgaaatgatccatattgtaatagattagggtgggagacatcagtctgaactcatttttagctcagtattgacacaaatggttgcatacagagatgtttataaatatgtgtatttacatgagttagttttcagatgtatatttccttctttgtcagctgaaaagccttagaagcaataacattccagtagcaacaagcacacctatatccagatcttgatttctgatacaataaaaagaaccagaaattcttggagaaatggcctcaagcaggaaatagatgagataagcctggaccatccaatagtgccagaaagtaagtatgcaaaaaaccacaatgaggggtaggtcaaagtgatacagaaaccaacttaagagttcttattgaccaaagctggaacaatgtaagcaacaaaataaattattggatcataaaccaaagtataaaataagcacccatgggtcaatactggtttatataaatgactgaataaataaatggggataaacagacaaatctcccatgcaaaagaattcaaagttatttatagaataactatttcactctaaagaaggttgagcgtaactcctcactccttgagtaggactgtgcatgttgactttcttacaaagagtacagtaatggaagtaggggttggaggggaagaaactttacagtgaaaaaccctgacaaacactgcctcagctggatgattaaggttaatatcaagagtgatatatcatattggtaatatatacccttgatacgaagtgataataatagcgctctacctctgtgatcctcctctcaaaaggccgtaactccagtctattagagaaaaatattaggcaacccgcaactgagggacactgtacaaaatgcttgacaagtattcatcaaaaatgtaaaggtcatccaaaacaaggaaatctcagacactttcacagccaaaaggagcctaaggagatattatcactaaatgtcatatcatatcctagattggatcctggacccgataaaaagacactaggtaaaaattatggaaatcagagtaaagtattgactttagttagtaatagtcaatattttttcattaattataattgtattatgctaatgtaatattaatacaggaatctggatgtggggtatatgtgggaactctctgtactatcttcacaatatttatgtaaatctaaaactattctaaaataaaaagcctattttagaaaaaaaggtgacaatttaaaaatatttttaacacagcatattcttctcacctctcctcattgtgatatttccttggcgagacataagcctccttctccatttgacaaaatctgagacatggcttcttctacagagtcatcttcaacctctccagacagtgttcattttctctccttctcttgatgccaaggcaattatctcataacaatgtaatcatatgcttgcctttttccactgtaggctgagctctctgtggcctccacaatgtcttcgtgttctctctaatgctactccagcaaaatgctaaacgtaatagagtcactcaattcatgtttcttgcctaaacaaaagatcattgtttgtaatgctttggcattttttaagttcacatacatgattttcacacattcatcctagtcaccttgtgtgttgacagtcaactgcttttgccatttataaatgagtaaattaaaactcagagagtggaaaacattattcctaatttacacaacttcaagcgctggaaaaataaaagcatttatttcagttctaatgattctacatctactttccttcatcatgtataaatagaagggtagggcttttcacctggggtacaattttgggaccgtacactgctatctctgatcttgggcaagtcactaaatccaggtgaccctcaaagttctcatacattttaacaggaactaatgataacatatatgctttatatatatttgcacatatatatgcatatatacacacatatatatgcacacatatgtatacatacatatacacacacatatatatacacacacacacacacatatgccacagtcaatgtgctctatttgggccaaaacatgggctcttttttggagttatcctcctctttaaaatataagcccaatggcaagaaaccagtcatctattcaagatggccatttggactatatgacctctaagttcctttccacatattttcttttatagtctttattttctttgcagtccccaagtagtgcagcatacaacatcagagtttcaataaaggctggctgactgaagctttcaaactcccaacacaatcacgtttatgttgccaacttttattcagtttgtgatttatgggcatatggagtgttttgcatcccagagtttcctcttttgagtcatgatttgcaaatggatataataacccataaactgatatcagcatcaaaacagagccatccaactcgagtaatagatggccttcagaggaaaaagacactagcccattaggaagagcacaaacaacaagcaagcgagtgtgaacaacagccttcataaagtcagtttctcagttcattccacacattctgtccattctaagataatgtgtgtgacaagggcacaatctaatcagactctcactctcccttggcaaggcaggcttgcaacaatagactaaacctcagccctgccaaccccaaataggcatgccagtctgcctcattccagatttgtggcttgtctccacaaagtaatagtgattctcttgtctgtaccaattgcaggctgcagatgggtagcctaatgctgtaatttcggactaaattctccacagatgaactggaaaatttcctcactcattcagaaatatgccagccagctgtcagatctccaggactccctcacttgcccagatcaccaatgaacagacggcgttcaccacaatgattaggctgtgttttcagttcaaatctttttctcctaattatttaatctatttttctttcttcgaagagtctggagaatggtcattggaaatttcttaaccagaggaatctttaagaaagcaaccgagaaagctgcttttctcagttttttatcccttgggatcagggataaaaaagtgtatgtctatgagctgttcactggccatgaccccattccatgccaatcattcttccaaggtacccagtagaggacaccttttttgtgccaatagagacagggaatagggaagcagatgcctgctaactacttgactgccactacccataaaggatacaacataattttaggggactccaaaagccaatatacaacatttaagaacaagaaataagtgataaatgtatacaaaaagtatgaaagaagaagcaattttattttcatttataagatatgagaacattgctcagtctcaaatgtcttttttgacttcccatgtttaaatgaataaagagaactttaaaacatcacctacgcttaggttttattgttgttgcttggtagaattttttcttcctttagcatttgatctgtgtacaattcgttcacaaacatctgagagtgtccattcacatggtctttctctatggagtgaagattttgacaaatccaaaaattctttctgaatgtgtttctctcagggctcttccttgccaattattagtctaaatgattcactcacagataccttcccagggagcccaagtttgggggttaaatagactaaaatccaaaacctggctctgtcatttacagtgcgcaagacatttggaaacttatttaacttttcatagccttaatttcctcatcttacagagttattgtgaggcctctgcacatgctgtcaagcccctgccaaaaactccccaatgacttcccacagaaactatatagagtctaccaggcctgttaaatctggccgctgcctacatttttcaatcccatctcattctagtctcttcctaacacaacatgtcaaggactctggcttactttctgtttcttaaacatgccaaatacttgcctctctcacagccttctcacatcctgtcttctctacctgaatttcctcgctccctgtaccagggctagtttcttaacctccaggtttcatcgctagtatagtgatgccttgaataacaaagttcccatgaaggacagaccacatatgcaacagtggtcacatatgattataacagagctaaaattcttattgctagtatgccttatactatgctttttattgttttagagtatactccttctatggtgtatgtgtgtgtgtgtgtgtgtgtgtgtgtgtgtatacacatatatatgtgtatatatattttatatatatatatatatatatttatatatttagaattaaccataaaacagcctcacgtaggtccttcaggacatattccaaaagaaagtgttgttatcataggacatgacagctccatgtgtgttattgcccctgacgacctcccagtgagacaaggtatggagactgaaaacaatgatattgatgatcctggctctgtgtaggcatagactaatgtgtatgcttgtgtcttagtttttaacacaaaaagtttcaaatgtaaaaataattaaaaataaaaatgtttttaaacagagaaaagcttacagaataaacatataaaaaaagaaaatatttttgtacagctgtacaatatgtttgtgttttaagctaagtgctatcacaaaagagccaaaaaagttaacataaatttaaaagtttataaaggaaaaaagctacagaaatataaggttaatttaatattgaagaaatatttttttatacatttagtgtagcctagtagtacagtgtttataaagtctacagtggtatacagtaatgtcctaggccttcacatccactcaccatcactgactcacccagagcaacttccagtcctgcaagctctatttatggtacgtgctcttatatgtgtgtgccattttttatcttttatactgattttactgtacattttctatgtttaaatatatttagatacgtaaatacttaccattgtgttacagttgcctacagtatacacactcttttgaatctaatatcctaggaatgtgtctgaataagtaattttagattttcacacaatagttccaatgtgtaagagagtaatcaggtaaagaaagagaaaatgaagagactgtgcctgggtttaatctctatataaaggaggcagcaacatgaagactccagaggagtattaaggggctcatagcacttatattcatagtaaacagggacagataggagctaacatttattaggcataacagtaacatactgtaaaggtttgtaggctaggagcaataggccataccatatagcctaggtgtgtagtaggctacgtcatctaggtttgtgtaagttcactctatgatgctcacataatgacaaaattgcctaaggatgcatttctttgaatgtatacaacatatatctttattatacaggtcctcttctttgtcctgtcatggtgcctattggttttctttatagctattcacacaatttttgcttatgtatttgcttcttattagctccctccttcacggaggtagacactatgtttgcctggaagatttcctttctcacaactctgttgctttgagtacttgcttttccttagtgacaccacttagacttcctagactaggctaaattccctttgtatatatttccttagcaccttgtgctttccttctggaaccctcaaaatacttctaattccttgaccattgtttctctttcctaatatacttccatgagaagagggtcccagtctgtcttgtactatgtccacgctgctcaatatagtacccgacaactagaagaggctcagcaaatgttacctcctatctgtccccatgttactatgaattgtaagtcccatgagccccttaatattcctgtaaagtcttcatgttgctgccttctttacgtggggattaaacccatgtacagtctcttcattttcttttattctcttgcacttcaaaaccatcatgtgaaaatctagaattagttattcagacacattctttggatattagatgcaaaaagtgtgtaaacacagagcaagcagaatgtgtagaatgtgaagtaggatgctcacccatttgctttgatggtttagggtgggtaagcaattatacacgtacatactaagtaaacatgacctggtggtttctgagaagcttctgataaatgtatctctttcctaattttacagttacatcttgtcttctttagcatttacattttcctcctagctttccctcttagctctccatagcagcctggttttcactttttgtgtcttctagcagtgggcatttttcccaaacaccaaacctaaggtggctacactggtttgcctttctctatgggaaatcctgtcctcaaaataatccccagttggcgaaatgcatagctaaggaaattgttgtcacatgaccaaatccaaatcaagctgtcaaataaagaagaccactaaatgttctggataggccaaaaataaacaaaaagtatggactttcacagactactgataaaaatgttttattcctcttctagaggacttcccatgtttaaagtcaccctcatgctaaaactctgagctgtggcaattaaaaataaagctatattctttttgatcattttgttataataaaataataggtattttccttcacattcacaattatagctttctacccctcccaaaaaattcttcttctatttagtcccaagcaaaataaaattaaagtttgagaagctgtatgacaatcaacagaaatgctatccagagaacaatagcaatcctataatggtaaaaagttaattatatgaagacctgcagaattttaaaatgtcagaataatagagcaaatttattgaaacgaaactgagccttgaaatgcttaagctttcacaggagcacacaaatttatatttcaataaacttttaacataatgtcactttaagaatgaacaacatgtaaaatggccaaggaacaacattctcagttaaacagaaaagcatctctgagacgtttgttatagggaaaaatgcagaccctgctgatatggaaatggtagatattcactgctgactacagcgatgaaaaaacagttctctgaaatacaggtattgttcaagttacaaagaattaggcaatattacaaagctaacttaaggttttcttgtctaggagggttatattttctttccttcccttcatgtattccatatctatctcttacacatggcaaacaaccctatccttctggtcaaaaaagctagattttaatcctgatggcgtgaagctgagcaaggaacttcattttctgaacctcagctctttatcgaactatgccttatagatttctcataatacttacggactaagcaaagcaaggtgtgcaaagctcttggcataaagccttgcatatattgtatgcccaataaatgatggtgactgttaccattttcatcttttatttcaggaaaatagaaaatacacatctcttgttgtcttgtgactttaaatgtgtcctcttggtcaatcttcatggcactcagttttatagttctcaaattccattacagcaatttcaaaatgttttgcagcagttcacaaaactgataaatagacagtcaccatttaaaaaggaaaaaaagtatcatggatgacctaaaatatcactgcagtcacttgagcactgaagttaaaaaaattcaatactaaaagtaaaatgctgtcttttgatgatcactcacagcaatgcgattgcaaagacaattgcaaatttggtcataaatcaagcggaagtttttaaaactggccatctaaataggcaacaatatatttatactaattttaaaaatcattttgaaaattttaaaagttttctagtcctgaaagtccttgtgggttccctggggaaaaaaaaaaagtcatcattatatgccagtttgtaaaaccaaagttatagagcaaaagaattttgtgagtgttgttctagagagcagattcatctgcagaggctagaggtgagactgaactgtacccacattttacaataaatatatgtattcctatttaaaatgcatttaaaaatcaatgctttaaagaaaacagggtaaaaggaattacaggagggaaaaactcactcccatattttctttgtattttttactttgctttgcatattttttcaatcattctttgagaagtttgccataaccaatccaaggtcataatcaaacctatggagctaagtcaggtaatataaaaaaatttatctggtcatgtgtaagaaaacgtggaatggcaggaactctggtggactaaagagcaaatactccttataatgagggcgtaacttctatcgggttccaaatgatcattaccataaaaagacatgtgtcccagatcttgtaatttttaataaactaggaaactagaactttatataaaatcttatttttcagtgatgcagctgttttaactaaaaaaaaaaaaaaaaaaaaaaaaaaaaaaaaaaaaaaacaccactacgcaagctaaacgaaacatatctctgagccaaattcatccccagattccaatttgcaaccatcagcatttagggacaactgaggggcaaacagaaccaaactgctgggtggtctgtagaaacctttgtctcaccagatgggttgggagattaaagagtttgagacccactgccctaacatagtagcatgaacgaacatgatttcaagaatatctagttgttcattttgaccaagggttatttaaattagataaggattaaaattaattacagccttcttatagctgagtagctcagtaagcgctgcttggaattatcttacatcttgatgtctctctacacatagaaaccacccagcaagtcactaattggcatattctgcagaagtctctggagagaagctaagaaagtgagcacttgctagcttctgcatgctcctcaagcatgctttccctggagatgggagctgtcacaggatactttgatcactggaggcgctggggctcctcctcactttcaatatgtccggactttaacagaaacacaatattgtactaaatccaatcttttttttttatacttatgaggaagcaaaataaaatggacaattaaaaatctatgaaggtcgattgatttcctctactagcaattatgcctcataattgtttgctgaaggagaaattggcattttacaaagccaatgattggctgggattttgtgcttactaaacctctgtggatttagagtttgggtttggataaaaaccatgaattgagcagcacttgagaagcctctccaaaagcctttcatctagaagcaggctggtgagttcacgaggtttctgacatttctcctatcccaaccaggttggaaccccactgtaatcaaaattcacaatgttccagaacctagactttgtttctcattaaaaatccaacagacaaaaaaatccaggaggcctgctagccaaaccttttcacacggcagggaaggtttgcattcagttttattttaagttagcagactaggtcggaactcattttgaagcctgatgaaagactgagagcctgcgtttcatcttctgattaatccaaaattaaacaattcagagattttcatcacttggtcttttcttttaaacatatgtgacagataagaaatagccatctctagcacacatagcaggatacattgtgtttgcctgcaggctctttgtgggccattcttaagcttattctaagatcagatagtaaatcacaatttccttttaagggactgttacagttttcacctcttattgaaaccaaaatgtgtatttttcactacttgaacattacttacctgctgttcatagtctctataaaaaaattctcatcttatttaaaaaaaaattttgaagtgaatacatgatttatgcattcttgtaacacaagaaaggaaaaggaaattaggcatatatctcaaggctcattagttgcatttgagttaaacataaatttttggaaataaccaagtattttgcaattccaaggttttgtttcctaaatcaaaactttaaaattaaaagattttgtaaagaataaataagcaacacttcaggatagaatgtgaaatccaatataacaagtaacagtatggatattgcagggagacaaatgacagtccctctagataaagtgcttgtggccatcctattcacccatcttcaataagctcaccttttgtaaccacctcaatccccttccattctggtttccctgatttcctctacccttgtacttccaagcacagtaaggaatttcatcactcaagtccccatagaagtttatctctgtctttttttttttttttttttttgagacggagtcttgctctgttgcccaggctggagtacaatggcacgacctcggctcactgcaacctccacctcctgggttcaaaagattctcctgcctcagcctcctcagtagctgggattacaggaatgtgccaccacgcccagctaattcttgtatttttagtagagacagggtttcaccaggttggccaggctggtctcgaactcctgacctcgtgatccacctgcctcagcctcccaaagtgctgagattacaggcatgagccaccacgcctggcttctatctgtctttttctttttttttttttgagacggagtctcgctctgtcgccaggtggggtgcagcggcacgatctcagcccactgcaacctctgcctcctgggttcaagtgattctcccgtctcagcctcctgagtagctggattacaggcgcacaccaccatgcctggctaatatgtatttttagtacagacagggtctcatcacgttagccaggatagtctcgatctcttgaccttgtgatccgcctgcctcagcttcccgaagtgctagtattacaggcgtgagccaccacgcccagcttctatctctcttttctaattcaccacaatccattgtgattatttgtctctatggatgtcttcctcaaagactgtgatcttcccaaggactaaagcttaattgtctttttatcctcaccatagagcaaaacacctgatatttcttttgcatatgcacttgttcatttacacactgaacttgcaaatgagtattttgagatgctttataaaaaagaggttcttacaatttgctggaagaaaagacacagccataagtaaaatagaacagagtaaaagtaaaaggtgattagttggtgcccagacaattgctacacagtaccagtcagggtctcagcaggaatctgatggcacattcaaattgaatccattaagtagagtttaataaagagactatttgcaaaggtgtcagaaggatctaagaaatgaaaaataaaaagtggatagtagagtgcctccagaaaaataacagaggaaaactctggagtttttactactctcggcctgaagggcaagacgaggaagttgttagtggtagccagagaaagaactctgtagagagggccacctgataggaggtgtggacttaccaagagaagtaactaacctgcagagagctcagagaataagtacctagtctcactctctccgctcctttagatctctttccggaacctctcatgggccaaatttgatggaattccaagggcagagaaatcccttgatagagttgatatgaatcaggccccagagcagggagcagggtgtagaaagaggtggaaggagaagacatgtaacacatagtataatcttgcaaattcatttctgcccattttagcaaccagccagaacaaaatgagatgcctaattggtttcgaaaatctgtgcatttatcattaatagcatatcaatggtttgtgaaaagacacaaagacttgagataaaaatctcccatgggaagctctgagagtgactttcgtagagttccttcttgtagcatgcaccgaggcacactgaggcacggtatacagagcaattgagaagtaattctgcaagttcacaataatgggttataaacctaccggtctcatggcttgataatataaggctaaattttagagaacttggagaaactgtcaaactgagtatctttgatatggtttggctctgggcccccacccaaatctcatctcgaattgtaatccccatatgtcgagggagagacctggaggaggtgattagatcatgggggcagtttcctccatactgttctcatgatggtgagggagttctaatgagatctgatggtttaaaagtgttccttcccctttcactctctctctgtcctgctgccatgagagaaaggaccttgcttccccttcacctctgccatgattctaagtttcctgaggcctcctgagccatgcagaactgtgagtcaattaaaccttttttcggccgggtgcagtggctcacccctgtaatcccagcactttgggaggctgagacaggcggaccatgaagtcaggagatcgagaccatcctagctaacaaggtgaaaccctgtctctactaaaaacacaaaaaattagccaggcatggtggcgggcgcctgtagtcccagctactcgggaggctgaggcaggagaatggcatgaacctgggaggcagagcttgcagtgagccaagatagcgccactgcactccagcctgggcaacagagcaagactctatctcaaaaaaaaaaaaaaaaaaaaaaaagcaaccttttttctacataagttacccagtcccaagtaattctttctactttgtgaaaatggaccaatataatcctttatgtaattctccatgagtatcagccactttctttttaacaaagatttttaaaacagttgaacaactgacagttcatattctctgacaaaggcaaggatcacatacgaatgaaaataaagctgtagtcttacttatcaaatgaacgaaagatagggccagttctcgcgtgaaatgtaaggtgcctaattctaatatgtatctgaatgggtgttcaacacaagccaccccacgcccacagggtcaggatggtcctaaactctctgaaagactcaatcaacatttgttttaaaaagcagaaattatcattctactctatgtgattaacttttgttggtgggtacaaacatattgttggatagaagaactaagtgctaatgctcaatagcagagcagggtgactacagttaacaacaacgaactgcatatttcaaaccagctagaagagaggatttgaaatgttcccaacacgtagaaatgataaatgctcaaagtgatggatattctaaatactttgacttgattatgacacattctatgcatgtaacaaaatagctgatgcaccccataaatatgtataaatattatgtattgattttaaaaagcagaaattgaaacacacagtggggcacactcccagtttgtgctttctttatctttgctaccaaacagatgccacaggaaagcattttcttctcttcagtatatataatgaaagaaaccagttattttactacttgttacaattaaaaaaaaaaaaagctcatgtccccttctggtgttctaatcatcatcatcactcagagttttaaattgcttactaaagtgccagacattctactgagtactttatatgccttacctcatttaaattttatgtaaatatcaccatttccaatttacaggtgaggagactgaggaacagaaagcttaagtaatgtgctcaaagtcatccagcatgccagaggatttaaactttgaaagtctggtttcagagacccgcctctaaactgccacacaatttcaacaccgtagtctaacatgagacagggaaagtagattggaaagccttcctgggaaatgagaaacgacagaaccaagaattgttgcgcaaataatacttgtagctaaacacttcccaaactaggattttacaaaacatcttatcctgtaagatgcaaaaggaaaacaaggattccaaggatagtgaagctgaaaaacacagcatagtataattctattttatgagaaatacaatacgtatgataatattacaggctctgataaaatatttattaaaatattttttctctttcattatctagatgatcctaaagttatttcatcaatgaattcattcattgcttcattcaatgaaatgacctgtgtgttcctaaatccaaaggacttctaggcagctctagacacaatagaccttgccctccttttgaaacatgctctttgcatggctgtgtaggggccaagggaaaatttcgacttcagcctctgaaaagtttgccgaaaatcaaccgacaaaaggcagattaataggagaaaaggcatacaaatatactaacatgcatgggagtcatgcaagatataagagcgcaaaacaatggccgggtagttgataattttatgccatttcgagggtatagaaagaatgggggcttggagcatggcaaaacaggttatgggatggggagaaaagaagacctagctagcaaaggtagtgctgttccatagatgaaacatcacaggtagcagccctcagagaagatatatggcaaatgtttcttttaaacctttaaaggtgtcagactctcagtcaatctttcctagatctggacaagggagggcctcagagaaaacctggctgcgtcaatgaagattctctacagatacaaatctttcccacaaaagacagctttacgaggctacttctgtttgcaggtcctctgaacagccatctaaaaatatgtcaaagaagtatattttggcatgaaatattttggcttttatcagcttttgcaatataatgatcttggtttctttccttctatatatttttggttagtctttcactagctcatccactgcctgccagtcagcaatatttggagtcctcaggcctcaaccccaggtcctttccttctctcactcaagagtctctctctagattactgcattcatagctttaaaaatccacccatttgcagatgacacccacatttaaatcaatatcccagacttctttaagctccaaaaccatttttccaacctcccatttgaaatcatgtttatgatgtcccaatgtcctctcaagtgcaatatattcaaaggaaaccttgctattttcctcctaaaccttgtccccttcctgtagtgtgctctcaggcagtgatagaaggaaacatcaatttacttaccaatacctgggtatcatcttgtgactctctttcccttactgcccatattcaatcatcatatcttgttgactctgttgttaaatgtctctcaaaatctttcaattttttcatcttgacaattataagtatagtccaagttaccaaaatcattttcctcacctttttgcaacaacatagaaactgtcatatgtagttgtccctcagtatccacagaggattgtttctagggctcgcttacataggtcccttatataaaatggcatggtatttgcatataacctatgtgcattttcctgtactctttaaatgacctctagattacttataatacctaatacaatggaaatgctatgtaaatagttattgtactctattatttagggaataatgacaaggaaaaaagtatgtatgtgtgtagtacagacgaaatcatccctttttatttttccaagcatttttgatccatggttggttgaatccacagctgtggaatccatgaacaggaagagccaaccctgcatatctatcgtgcatcagccactctaatccaatctattcttcaccttacagacacacccaacaagcccaaaatgtgtgatatttttaagtgccaatataatttttctacttaaaatatatcaatggcttgtcatttatttgattataaataaaaccttcttaagatgtccatcagtgccttctatgcatggcccctgtctatctcttcagcttcatctaagatttctcttttgctcagtctccatttgaaagacctggaccttttgtaatgcaacacacacgctgaactcacacctagaatactggcacagcttatttgttctatgtgtttctttttcttcctcttctatttagtaactactcaatcttaagatgttagccatgcatcacttcttcagaaatacctactttaactcccagatgagacctaatgcccctattttaaactttcatgaaattacatggttatcctttatagaacttgtcttatttacaattttacattttctagataatcattagctcaatatttatcttcccccatgacttgaagctaaatgagagcaagcagtgtactttttgttcactactattatctctagtgcctagcatagtaccctgaacaatgtaggtggacctggagccaggcactatcttatcagccccatgctaggtgctgtcatagaacatgcaagaagataaagggcacctctttgctcatagaatttgtagtctagtgtaagaaaaaggtaatcaataagcaagtgcaatgcaatgtgtgatggggttaaaacatgtgcttctggggaaaactcagacgtggatggttaaagaagattttcgtgaaacgaaagacctaaataataatgatcactatgtgaacactgagtgcatagcaatttacactgctcttcatctaataagggaggtacataggaaaactagggggcaaaaaaggtgtgtgacttgccaaggtcacttggctaattaaaagaggatctcaattcaaacctagacagtctggctcccctagtgtgttcttaactccatattgtgtggaatctttttgggttacctagacaaaggagagtcaagagatagtcagggttccaaaggaagggtagagcaaaagcaaagactctgaggcaaaaacaaagaactctgagcttctgagaaactaattaatcatgttgcgttttttgggggtgggggggaaaccatgagcgacaatggagagattcaactggagaagggcaaaccaaaaacagctaactctttttaaaaatcctattaaacccttatcctttgggacgtgtgtttttggaggactgtaagagaatattgctcgaaacaaaccaaagactgttgttataggtccagtacctacatgagccaccactccttttcaggaccacaaataaaagactacatcaaattaaattactttacaaatatacattctctagtcacaaaaagggctcaaagggagaatttgacttcattcaaaacaaacctactccagcaggttcacatgaacctcagagttttagaacttgaaaattttttatcttaccaagtctatttgcaatgatgaggaaaaaatacaaagacaattctagaaatcacttcccctaaaaaatattcaaaaaggatatagttaaaaaatatagaaaatatagtgagctggtcctttcagcctcacatctttgaaggactatgcagggaaagagggtgtaatgctagatcaggcatttttgcacatattatccacagagaaatctaaatctataaccatcatcataaaataaagcaagaagaaaatcagaaagaaatgaatgaagggcaagtgatagccgaggggctcacaacaattaattattaaaatgccttaaaagagcaaagaaaatgcttatcagatcagcaaagcaccttttaataaataatatgatttgggtttaattaatggcctaattacagttttacccaataggcttaaatgctccaaaggagcagtttgagcctctttggtagataatctgtgtttttaaaaatgttctaattacatatttgcttgagtaaataatgtgcattttacaaaactgcctaatgatatatttatgtgactatatttacccaaatggcctctcattctgtactaatggagttgggattactgttcctgagagatacaggaaaatcggatggctccagctttcaccctaacacccctgttattctcacactgttctcgctctctcaccccaaaacataccactgaaagcatatgacccacttattcatcatcagtttaaacagaaagaaaattcttcctcagccttttgtgtaaacacattttgcagagaggatatatgcttgaaaaatgagtattaatactgtataatgctccattaaaaatagataatgagactgtgaccaaggcagaacatccaaggtttaagtagctgcataatttattctgttctttttatagtaagttacaatctttacaaagactcagactgcatgtattggaatcagattgcgatggcttaaagccacatgatggtctgcaataagtaacagacaagtcataaaaaactgagttggaacctcccagttttgtggtggcactctccattcataacttttaagtcattttttgtgtgtttttgagacataaatctagaaaaaatggatgcatattcataacattttatgaaaaggcactaaaagttccatttcatagttttcccataaaatctgactcagcagacatttactgtttgaaattaggtgatgcttcattcacaaattaatgaaaagattccttttaagcattgaaatatggtggctcctcaaaaaattaaaaatagaaattaccatatgatccagcaattccactcctgggtatatatctaaaggaattcaaagaaagatcttgaagagatacttgcacgctcatgttcacagcaccactatgcacaatagccaagaggtagaagcaacccaagtctctattgacagaagaatggataaacaaaatgtggcacatacatgaaatggaatattatttagccttagaaagagaggaaattctgacacatactgtaacaggaataaacctgataatgttatgctatgtgaaataagccagtcacaaaaaggcaaatactgtatgattctacttctgtggggtatctagagtagccaagctcattgatacagaaagtagagtagggatttccagggaccatggggatgcgagaatgggtagctgttatttaatgtgtattgagtttcagtttcacaaggtgaaaaagttctggacattggttacacaactatataaatataatcaacattattgaactgtacacttagaaatggctaaaatggtatattttatgttatgtggtttttgccacaataaaattttttaatgcattaaaatccttttaagatagtctatgtattggcaaaggcttactatttccttcatgcttattaagcatttactgtgtaatagtagccctacaagtaacacagaagtgtctttaattcaactctgggttggttaccacatcagccaaacttacattttttataggtttccgtaatcaccctcttagatacagttcactatccccattttacagagcaagaaattgaggcacagaagtgttaaaagacaaagcagaaatttcaagtcagatactaggtcacgagctcaactagaatatacactcattgttcaataatctatgtaataaagaccagagatagaagactaatcactgaaatggccccaaacctttttcaaaggcacattctttctggtgtccacacccaatagaaaataaagtttgactagaatcgactctcatttctcctttgttattaaaacaatttgtcactgtgacaacaaacatctattgaaaacttattctgtggcaaatactgcatctttcctatgccctgtaggaagatactattacctccccattttacaggtaaagaaactgaagcttagagaattgaagtaataggctcatgttctagtttataactacgagggctaggatgaggtttcaaacctagaccttccaacatttgagctgcactcaataattactaagtatgactttccacttggtagagggaataattatagctggctagttggaaaggcctgtggaaaggtagacaaaaaagtcttgactataaaactcccacacaatggagagaggactccattacagaaccatacagcaagatcctcccagggtatcaagccctcagcagatacgaattattttaacctgtggctttcttgttcacactgcccttgtttctgatggaatgcaataggagttacactcaagacatgtatagcactgtggtcaagctaacaaaaggaatatggatcacaattaccagcaaccaatagtaatagaggctaatacctctaccggatatgttttataaacaaaactaggaaaccccacaaaaacctgaggcaaataccgggcatgtgctaccagtcagacactacaattaaggtgtagatattcatgaaaagcaagatttctgctatctggcatggcccagagaaagaacataaaattcctattttttagtcattccatgaacaaggtaagtttgaaacacatacaaaaaaagataaaatagttcattgagagaagaaagaataagaaaaatatctaggtgacagaatagaattgaggaataaggttagtatgcaatcctatgcattcaataatagcctacagactctaagcttcctagagaccaaagcaaagcaggaaagtgacagttacgtaagtcagtcaaaatcaaataatcagaaaaacagatctcattgattttcagatctaaaaacggccactttttgcacataatattttcaacaacatcccaatacagggtacaatagtgagtttcatatgactgcaaattaccatttaagtcaagggcagagtctcatattttaaaggatagaatccataacaaatataacattaactgtactggtcacagtgacagccctcttggatgattcagaagacattccaataattgcagggactcagggccctcattatgggcactaattgtattttactgtaattgggtaaaattgctacttgagagttcaagttgatagagtgccagattaactaattttcaccttaataaatgtgcgattatttatcaaaattttgaatcccaatgctgacacacttataaattatttcttactctgggcactacttcacagagttcagatgatcccattgtgcagactgaaagactcgtgattccgaattgtaaagattatttacagcatagaccccaaagcactaaaatccattcatttctttcttctaatccaacagcctctgagatggcttgtctgcaggggtgcagcagcagcaccatctgtttactctggcctcatttgcccggatcaagtagaaaattgaaggcactaagctgaatttttcagaaactttgcagtaattgaaaaaagaagatgataaagaaaaagagaaaagctgtttggccacttaattatactggtcactctgtgggctacacaataaaactcacacatatttttgaaatagcaccaagctaagggcataccataactccaagcactatgtagaggagcccatctactcaagtagtcatttaaaattagtatatgaaactcaaccctgccgtcatttattattgaaattgccttaaggtgatctcaaaaaaaaaaaacttcatcttttgatttacctcctcctcccttttctaaaagtagcaaatgaaatttgtgggattagcctcttaggagcaaatcgacagagacaaaatgtaaccatgagctaattcttggcagggcccagaagggacgtgccaagaggacatgggtggatcatgggagaattgattggaaagattctgtgttcccagaagagagcaggcttcagtggtttctctcaagttttattgcacgttagcacagccatatgctctgctcatgtgagcagcacctggggggagtacattggcttcagactcaagtggagacttgggaagtttgtttagtaaatgagacctgcgataactgcagaagcggcccctgtcctccacttatacataatgtatttcttcacccagtctatgagagttaggtttttttttttttccattccatgtccaccaagagaagaaaaaaaaaacctttctgttactataaaatacacagaataaaaagtctatcttggtgtaagaggatagtgagtggctgaagggagaggaagaaatcaatatgtcttatcaaacccacatcatattgtatataccaaagtcattagacccagagcctacttcttaggaataaatattttgccctaggattaaatccctttatgccacagaagttgaatttctttcagccaaccagaaaaaccacaacaaacaaaactcaatatagcatcaatagagtggaaaatgcaggaagcaaagattctgtaggtttaaatgggaaaccctgtagtttgttgtatcccagctcagaaccatagcattttgggcagtcctggattgtaaaacttacagctggaataagccacatttgcaactggtactcatcctggtccccaccctcactccctgccctctactcagagtctccctacagctgccactgtgttgtcacaaagctcctcacaactcacccatttggaagcccatcctcttaaactgctcttcctggcatcctctcctactcatctttcctggctcctttctcaccatcaaaccttgctgtttggtttgctagtttctcagaaactaggtaacaaatgagagtttaattaaatatagagataaaatgcaaatgtgttacaccctctagaaagcagatttatagttaacagaggcctcagtactttaactcatgggagagccgattggtagaacttcgggaaacatggcagtatggaggggaaactatctgcaaactagtgtcttccagcctattccagcagatcacactttatcagttatgatggtttggccgcaagtcatgaaatctctaactcaaatagccacaattataaggatgtttatcatctcatgtaagaagtcccaagcactaacaaggtgtaaggctgacccatctctctaccctgcccctttcagcatgtgcccaagcttgtccccactaatccctctcatgttgccaagatgccccccatagctccaggcatttggcatagacacaaccaagcccagaataatagcaggtatctcatcttacatatctctatcagagagacaacattgatattacccactagcaatcttctcacatatcattggccagaataagttcatatacgccttcctaacccagtcattgccacaggtgatatagtaattatgcctgccttacactactcagactttttcttacagtcacttaagagaggacagaaattccaaacaaaattaagattcttttcttatggagcccaatagaacttaaatatcaatcttttctcatatcctaatgtactttggttcaaattcagttatcaaactgttccttctgctaaagcctttgccactttgagctttatggattgtagtataagagaaaaaaaggagaaagaacagaataattagaagatgagagaaacagaagagtcttaattttgtagagtctagaagattttattacatgattgtcagtttctcaaaaccactgacctcccacaataaccctaaactcagaagtaagtggttttcttaaaccagaagaatgaaattaggagcaggtgagtacaaacataaacaaggtccactctgttggtgatgtagaaattgaaagtgacattttagacagtgccaacacattaaaagcaccaataacaaacattgaagattatatttttctggaagttgagaaagccagcatttaccttaatccttcatttcattgatgcaaagtaaaaaaaaaatcagccatgcccactgctttaaatatcagcgccaccttcacgtggagtcaaatgattaaaaagcgaagggaaacctgaagctctttttgaaaagtaatttccatggacacacctggctggaggcaggatcgctggccttcatctctacatctgctaaagaacctcataacactgtgacttctatgacacagcttttcacagcctggcttatactatgaataatattatttaaaatagaaacaaggtcttctttacctttattgcacctcctagagcttgaaaatatgcaaattaggtgttaatctaaatttattggaaaataatagtttggtttacaaaactgtctgtagaaagtaactgaattattggctgggggctgtggctcatgcctgtaatcccagcactttgggaggctgaggtgggtggatcacaaggtcaggagatcgagaccatcctggctaacatggtgaaaccccgtctctactaaaaaatacaaaaaaaatagccgggcatggtggcgggcacctgtagtcccagctactcgggaggctgaggcaggagaatggcgtgaacccgggaggcggagcttgcagtgagctgagatcgagccactgcactccagcctgggcgacagagcgagactctgtctcaaaaaacaaaaacaaaaaaaagagaaagtaactggattgtttatagtgtgctctatttaacaatacagcataaggatgtctagaaagtttcttttaaatatgttaaagcaagacacttaaatcattaatgtttcaccattaaacattaatcattaatcattaaacatttattcttaactggctaaaaaaacgaagactgccagaacaaaggttatgaaatagttatgtttattgcagtgaaaaatcaagacacattagcatataaacaattttggatgaaagtttcactttcttaaaagaagtttctcgtacaaacatatcttaatacactagtatcagttaaacggggtcttccccaagagccaacactggagccttagcttaactactcttcccaacagtcaggaaccaaaaaagcaaagcgaaacacctgtgcttgtctcatagtttcactgcttgtccagggaacaccaaacaatagaaagcaaaacctgtggccagtagagcacattttactcagtggacttctgaacaaccatatcccatttgttgaataagtattcatcttttcctactcattttgacggccaattttgtctcctataaaatccaagtataatattgacttttaaggatattgctacaagtgcaccaccaccaaacacctaaaacttgacttcagctttccttgaggaactgccttaaccaatgtttgccctttctgcaagacccatgttttggcagccacctgtataaaaccatgtaaaatacctccccattgctttggcctaccgtagtgtctgaaactctaaccattaatatcattcaaacttttcaataaacaaccattaagtactatatgagggaaatgcattgattaattgttgggaaatgtaaaagttaattatatactatctctattttatagactatataatccactgaggaaaaggatgaaattacaaataactatactggaatgcaatatatgctaaaagaaagcaaacaatatccaacagaggatcaaactagaaaagatgtaatacaattaaggcaacagaggaattttttgtagacaaggaaatgtgcaaagcaccatgaaagtcagatttttttttttttttttttgagacagagtgttgctgcatcacccaggctggagtacagtggcacaatctcggcttactgcatcctcagcctcccagattcaagggattctcctgcctcagcctcccaagtagctgggattacaggcgtgcaccaccatgccagctaatttttttttttttttttagtagcgacgggtttcaccatgttggccagactggtctcgaactcctgacctcaggtgatccacccgcctcggcctcccaaagtgctgggattacaggcatgagccaccacgcctggccagaaagtcagatttttaacacatgaaacactgataccatacaagcagaagaagcaaatgagcaaaagtatagggatcttttttctttatacatttctttcaaaatgggcaatccaaaatggattaaaaaagtcactgaaagaccctgcattaaagagctagcagactacaggactcagagaaaataaagtaattgacaaggaggttctgatagtcaagggaagcctttgaaaggtccagaacatgtggttcatcaggaagctcttgaagcctctaggagcataatgggatcactagacaatgagatggagacgccaaaattagatttgccttctttaccgtatattctccggcagtctctaacctcaatgtgcattaatcaattctgacaaagcaaaaagaaaataaatccaaggatgcactctgctcaagaatatggaatctatattgaggtcaagcttaaggaaaacaggaaatcacagtgaaggttacggttctgatagggatttgggctggctgtgctttcattcctttctaggtcacactgacatgaagcccagagacagctttgaaatctgctgaggaagtcagcacatgccaaaatggaatggaattccacacctctttgctttaagcgtaaggagctcgcatcagaaaaagtctagtgttttaaacaaagcactgcttaatcattcttaatatcctaaaacaagccttttgatcaccacaaatggataagaaaacaataagacagacaacagaaagaaacaataagacaacagatgcgtgtgctaaagatataaatactaaattcataagaaaaaagtacaaatagcagacaaacaaaaaggttcactaactagtaatcaaaaaaagagcaaattagaaaacctgggtaccatttttcacttagtaaattagcaacttaaaaaattataatattctatttgacaaaagtataccaaagttctttctcatgaagctgaggtattagataatcacaatgaggctttgactcagtaattctatctcagggaatttattttaaggaaatatattccatctatttgacagatcatattcacatcataattatttctaataatgaaaattataaactttaatataaaccaaagagaatgatcaaatgttctgttttatatctaaaatagcgacttgaaaattctgtggaacagggaaaatgcttataaatcattatacaaaattagacgtatattatgatcacaacactgtatagcattcatagtgacagtgtctaaaagaaaatataaagtaacaaagcttgttttatttggatattggaattacaaattactttttctctctctttttcctacattttcactagaattgatgtgctgctctaataattaaaaactctgcttctcattcatgaatttctaaatgccattcgattttaatgaaattattttaccacaatgtttatttaaaatacctggacacttgtcgttggtcccattcagttttgccaataaaaaagaaactattacataaaaaatagcccttaggaatgcatcccatttttcaatactagctgagaaggatccagaagtcactcaccaggccaatcccactcccagcaacacaccttcaaatcccatatactggctgagtgcggtggctcacgcctgtaatcccaacattttggaaggctgagacagaggatctcttgaggtcaggagttcgagaccagcctgggaaacagggcaaaaccctgtctctgccaaaaatacaaaaattagctggacatagtggcgtgcacctgtagtcccagctactagggaggctgaggtgggaggatggcttgagcctaggaggtggaggttgcagtgaactgagatcccgccacaacactacagcctgggcgacagagtcagactgtattaaaaaacaacaacaacaacaaaaacaaaaccatgtactttctcttctagttacagtcatgtgctgcatatcggcatttcggtctgcaacaaaccacatacagcatatgatggtagtcccataagattacaatgtagctaataaattcctgtgtgcttgtgtcttagtttttaacgtagattttggctttagaggatcccttcaaacacctactattgattgaactattaaataaaaattaaaatggcaaagataaattagaaattagccgtttctattgcttttgttcttcctttttcctttttcttcttgtatttcttttcaagaatccttcactgctccgtgggagacgctgagtctcccaagctccaaacccactatcagttagaggaagataggagtcttagctatactactatttcttaatctataagcaaggagccaagatatgcaaggaagtatctgggacagtgagaagctgatgcgttgtgccatttcttgcatacatcttcagtggggttctactccaaccctaagattctaagattccccagtctctcccatgttctggattggaaggaaaagtttggagaagagagtctatcatctgtctctaattcatcagtcttgtgtcgaagacaaactgtgagaaaagactagatctccaggaacaaccaaaaggaaagattttgtgtgaggtccttcctgtaacaaccagctaaatctgtgaacttgtattcaggaatgaacaataacacagagcgccaaacgcggttactgctgatggaggatatgacagacaaatcttaaccttacctctatcccattctttttccacaatctctcctttgcctgtaagacagcaaatatctctaacagcagcatcaagcataataatcctctgagatctgctcccacagctactttttctccacctaaactttgacacaggttgccgtttgcaaacagtttgtactttacctatcacggtaatgattaacttcagcggtctcttgtgtctgagtaaagtatggtccgtggaacagcagtattgccttcacctgggaacgtactagaactgcagaaactcaggctgaattagaatttgaattttagcaagatctcagggtaatttttatgcacattaaagtttgcaaagtgctttaagaaaacctggagggtgacaccatttatcgccctacaaattgctatgagtgccaccacttcttgtggtatactgaagaaagcaggggttttggagtagcttttcctaggattgagaccactgctcatcacttagcagctgtaggtcattgggcaaattacctaacatctctagttttccatttccccatgtgttaagtaataaactctatatccactaaattgtgaagattatatgtaacaatgtatctaaaatatgcaattcagtgactgaaccagagtagatgaatatttgaaatcagaagcttaaagtatgagaagagactttgaaagctaattgtcaaatccctactttgcctcaatgtgctcagctttagccaatccctgaagatgataattacaaccttttctcatttgcattcctttactcaggagctcaccttcttttacataaaggaccaactaccccaaaacatctcctatcagacttccattgaacttaagatttatcactgttttgctattttatatagtgtcttgcttgtttttctgagctcattttgctttctttttagtcaagaatcctcaaaaacaaaatgactgtaacactggaacatggttgttgcaaactaatacaccactggatggtgacatatcatgttctcaagaccctataaaagaagtaaaccatatcatcagtttaacagcccttagttagagaaaagattaattcttttttttttttttttttttttttgagacagtcttgctctgtcactcaggctggagtgcagtggcgcaatctcggctcactgcaacctctgtctcccgggttcacaccattctcccgcctcagcctcctgagtagctgggactgactacaggcgcccaccaccacgcccggctaattttttttttttttagtagagatgtggtttcaccgtgttagccaggatggtctcgatctcttgatctcgtgatccgcccgccttggcctcccaaagtgctgggattacaggcgtgaaccaccacgcccagcggagaaaagattaattcgtaattcaaaaaatatacactgagcactgattgaaagaagataaacaaaaaataaaaagtctttgccctcaaaaaacttaatctgtgaaaatgtaatgcaataagtgctatgaaaaaggaaacatggaattttgggggagctcgtagaaagggggatctaaactatgtttttagggggtggagagagtgtttggggaagatgtcctagatgaagtgtcatttaatgtgagaaagtataagcaaattatttacatgcctatcagcacaactcacaaatcagaaaaagctggctgggttcaaatttgagctcggaggtcgagcaaatttattgacctttctatgcctccctttacacattagcataatagaagcaacgtttttatctacatcataggttaattgtaataatgaaaactttaaatatgtattgaaggctggcgctccacaaatgtttgctggcttaattccttctgtttgcatgaattgatgtaagaatagctatcctatctcataccagaatttctatgtgaagcaagtgggtcaagattatgagagattactgttctagtccccgaaaagatagctcaatgtgcatatggatctcaaattatatgtacatatatatatcaatctcaattttatatatactcgtgtgtatatatatatcaaattatatatatcttaagttatatgtatccacacacttacgaaaaatttttaaagtaaaataagaagaataaggtaagcaaaactctctgagaaaagcagacttcaaagatgcctcaaaatcaatctacccagcatcatactgtaagctccatcaaaccttccgcttcccacatgctttatctaaggatgaagacactctccagccataggcaagtcagaaacacaggagtcatccttgagatcttcttcctcatgcccatatctcactcaccctaagtcttgatgaccttgtctcctaagaatctcaaaaacaatcaccccaacttaaatcccttcttcacaatgaacacttggtcatgtggacctcagttctggacatatgtttggtatctagcataattacaataataaatgcaagctaaattaatgattttgtaactagatggagatcaataaagtgtagccataagaaaaaaaatttttaatttgtgatttagaaagtaccaatctacatttcattgactctctttggaaatgttttggtttgatggtaggaaaaatcttacaaataaatagatggtgatatctttaatagaggactgattaaaacataacatcaaaacctcatatgctgaaatagaaataacaaatgagacatagggatgtctttaggactgggatcagcaaattaaggccagcatgcctaatctagttttggtttttgttccactggaacacagccacacttactcatttgctattgattatagctcctttcctgttgcaaaggcagagttgaatagttgcaacagagactacagggcacataagcctaaaatatttactatctggctctttacggaactagcttggcaacccctgctttagaacatcagaaaaaaggcctctgtcaggagaatcgtttgaacctgggaggcggaggttgcggtgagccaagatggcgccattgcactccaccctgggtgacaaaagcgaaactctgtctcaaacaaaacaaaacaaaataaaacacaaattgtgacagaaaacaatgtactatggttttagagatttgtgaagagattaggaaaaaggggagatgaaggcagtgtttgagttaaggccttgtggtcggctacattatgaccccaaagataatcacatcagaatctctggaacctgtacatgttaccctatttgaaaaaagagtctttggaagatgtgattacattaaggatcttgaggaaaggtgattatcctaggttctttgggtggaccgtaaatgtcaccacaagtgtccatatgagagagaggcagaaggagactcaacacacacagaggagaatgcatgaagacaagagcagagatgggagtcacatcatggtacactgagaacgccaagcactgctggcggccaccagaggctgagagaggagagctaaggtttctttcccagagcttccagaatgagctcggcccaggtggtgcatgattttgaaactctgacctacagaactttgagataatatgttttaccattttatactcccaacgtcatggtaatttcttctatcagccacaggaaactaatgtagtcccactgaagaaaaatcgggctcatctctgctcaaagaagttgggaggaagaatgtgattgtatcacaatatttaaagtacctaaaattctatatttgatcccattaaattttgccaaaaaaaaaccactgttgcattaataaatagcatttaggaatgattcccatttttcagtgtccagaagtaattcaccatgcccattccactctcaacaatacagcttcaaatctcagtcactttctctttaattttatagtaacctgactgtggccccactattatgatttgcaaattttaggctttgtagagcaccagttctaacttttaaactgcatataaactcagaaagaggtttcagtgttaactctgccactaaccaattttatcaaattagttgacactttcaatttctggttcatcagaatgagaaagaaagaataaaggggaaaaaaaaggaaggaagggagggagggagagaggagggaaggaaggaaggaaggaaggatggaaggaaggaaggaaagggacggagagagggaggggaaagattatttcatattaattgacatgtaatgagattagaaaaaattattatagtacctcctgacatcagaagtcttctttttaaggaagctacctttgcttaagaaaaatatctcactgtgaaagaaagtgcaaccatgaagttttcagagataaagtgctctacataaaaaattataaaataaggttttacttttgatctggtaagtaggaagaaaggaaaaagaaagaggagagaaaagatagaaaggggagttggggaaggagatgtgagtaggttggagggaaaagatctgctggtccctcttccctgagagaaacaaacaccggtctcaaactgccctagtcctggttatctgccatgataacagaccccccaggcttactcctctgacctttcccttatcgcactaagaagatgaaattgggaatgttttacagcgccccccacccccaccctaccaccatacagcaactattgtgattcaaggagccaaacctaaaaaataagaaacaggcagggcacggtggctcacacctgtaatcccagcactttgggaggccaaggcgagaagatcacaaggtcaagagatcgagaccatcctggccaacatggtgaaaccccatctcttctaaaaatacaaaaattagctgggcgtggtgccgcatgcctgtaatcccagctactcgggaggctgagacaggagaatcgcttgaactcaggaagcagaggttgcagtgagccgagacggtgccactgcacctcagccaggtgatagagcgagactgtctcaaaaatcaatcaatcaatcagtaagaaacattagtcaataaaaccaggacagttggagtctaaggctctactcctcctttcatacacatgatggctaaaatggtttgaaaaggaaagagcatgcattttatattcaacaatttaggtagtaaaggctgaaaatataaattagattcaaaccataatccttcactaagtgctgtggtttgatacagaaagaggtacaaggggacatgacacaactagaagagaggaagggttttcctctggggagggtggagagtgccaggagaggagctgagaatggaaagcagagtgagggcttcactgtgtgtcgaaatgtagccctacctacacctcagcagggcaggaagcagctaccggacatgagtttaggaaacatttgcagaatctgaccacttctcaccacttccaccaccgtctctgtctaagccaccatcgtctctagcctggattcagctatggtgtcaccactggccattcttaattttcttaatgttgccaccataaggatatttacctatgtcagatcctgttattcctccattcaaaatcctgtaaaaatatctcacttcactcagagtaaaagctaaagtacttagagtgacttatgaggccctatcagagcccatctcctgctactttatacccctcccttctcattatcaaacacactggcctcctccttatttttcgagcctcctgccttagccccagtcatacccccagccatcaccactccctggaacttccccccaccccaactcacttcatcccaaccctgtccacaggctacctctcttaactctgagttctatgtttgaatatcacctagtcaatgaggcttctcctgaccacccaaatgaatgcctccgctcctccccaccttctgcacttccaaccaccttcacctactctagttttatattttatatattagcatttatccctttccaaattatataatgtatgtgttatatgtattatctccttctgcctccaacacctgggaatctaaagctctatgaggtcagggatctttgttttactcactgatgtaaacaatgcctggcaccttgtgagagctcgaaaaatatcaaatcatgaaagaaggtaaagtggaaaactactttccacaattggtaagttttttaacacagaataatgtaataatataataagtcaacatgtttttaaggcatcactgtgctgtgaaactagcttcaataaacatcacaattactcattcatttttttaataaatacttgaggagggcgtaccctatgccaggcactgttcccagttctgaagatataataattgagtgaaaatgtccttaaggaggttgaattatagtgggtaagagagacaattaataagtaaaatatttagaatgctacatgatggtaagtgccaagcagatgaagcaggcaaagaagctaaaactgattattatacttttaaaacaccaaatgagatagcttataataataaaagtgcttaaagaagtataaggcaaaggttgaaaattctatccaatttaagaagtatctttcttatgttttggttttactcaaagcaagttatagaagatgcgtcatacaaccctcacaaactcactgcctaagtggctgtgtattggcttcatattcaccacagactcctgcttcaaacccacagagagcactgtcattcctatgggcagatggtgcatgctcaccaggcagatgcagtgcacaggacctcaagtgcattcagtgattcccacaccctctggtaatccctcgatggcagcagaatgtgagaggcatggcagagtggccttactggctcagttctatcactctagttactcctgtggcatttcacactctcactaagaagtgagcccccaattcacttgactcacgtgagagcatcatttagttacagaatttatcgttattgatttgttttctttggttcccgtgaaagaaacaataaatgctatgagcagaaaatcaattgtggacattctaggcttatcatatatacctttaaacgcactcaaaattcttttcaaattatttgctgactatgccgccatcctctcacttccagaattcgccaagattaccggccctcttccctttgaagtcatgtgcagccacgtgacttactttggctgaagaaagtgaacagaggtgacttgtgtcactttctgatggatgtatttaagagttgtgttcacttcttcttttccactagcacagcaagccctgaacgttatggtgagatgatgacataagatgaagtctctatcaagtctgagcctcaaagtaactacaatgcaattattttggggaacataatatgaacaagaaataatcttcttttgttttaaggcactaagacgttttgttattgcaataacataaaatagtttatcctaactaacatcccaagtaaagccgtgacaatcctgcttatgagcacctggtagtctttcctccctaccttagggagaaaagtactaaggagcgcaatgtgcccaatgtgagatattaggtcatttttaaaagatgagtgaatttacagtgatatatgaaagaactgaagcacctggtctctatcctgagaccctaattactagagaagatgactttaagaagcaacataaaacacctctgaaatatcctttgatacattcctcgagaatctacttcaaatttctcaagaaagagggagcctgatttaaaagtttaatttttaaaaaaaaagttataacaatagaagacctctgggtaatggagcagaaaataaaaacaaaaattgtattggtgcaccctttgttgcctcaacagctcttaaagtgaccatggaagcaacagcaatgactgagaaaacacaggtccatcactcacagcaacaggaagagcagtgattctcccgtacatggcagcaacatccttatgaaaccagccccaaaggcttgcagccacaaacactctctatggctgagcagagattaacactagtacatatagcaagatgttatttgttccaagaaaaactgataaactatgccaggatgctgctaggtgtgcaaggtgggggcggtgggaaattgggacccagaaattttaccatggaagcccagacccatttcagtgtcacagtgattgctacccagatttttggcagtcctcctctagactagactgagaaagcaggaattcatattaaaaaggatgtttatggaaccatccaacaggatctagaatcagctgcaatcatcagacacagaattaatacattccttggatctttacatcatagcctttaatgacaactacttggaagctaaacccttatttccccaaatgggagaatcaacagcaataaaatggcataaaaattgaacttatgggatgccacaccaaaaacactttatacttttaaggacatctttatttatattttcacagtattttctttgaagtttatcatccaaataccatgcatatactacaaacagctctagacttctcaaccccctcagtctgtaagttgcttcaggggtagaaatgggtgcaacatctagaacagtcattccaggaattatctctgaggtatggctcccaccacagctcataggcagcagcctgaatctgcttcactttaatcaggaaagatagatggaatggagcccacttagttcgtggctgccagccctcttcgtctccctcccacagacatgcatacaggaaacctggcagctcccttccctcttcctgtcattctcactaggctaaggagtaggcagatgcaggagggagggggaatgcaaaggctgccagagcacttgccacattctgtgttgccatcacaagcctccccagtgcccagcatttctcaggtgctcttgctaggttcaagacagagaaatagatataagcaattgagcaaagcgccccacaagaaaggcacaccccaacatccaaggctttatttgaagtaacaaatacataggatgactatgccctgattaaatcctcttatttttacaagagagaattgagaaattacacagcattttgcactaaactcagaaaatcttcctgaaagagttcagagaagagcaaggaagagttaggcaaacaatgggtgaaagaggaaaaggaaaaaagtaatttaacgttgatggatttttttccactgtccccagtaggaagaatcccattgggggatagtgacatgtgcccaagcaggcaagtttaatgggcaagacagcagacaaacttgggatcatggtctacttcctttactaataaatgtcccaaatgctcccagcacaagctgtcaaaacaaatctagctttcctctgacttttgttgataggtgataacactcagctcaaccaaacaaattataaggctgctatatcaatgtaacctccactctcccgacaatcaaaaatgtcagggaaaatctacagcattatcttcactccgaaagacacactcttaagagtgagggatatagccctcagttaagtgatgcaaggcaaactgcacgagcagttcaaagtcctcacctagagctatagaactgccttccttaatttattcattcatacattccctgcaggatatattgcatttgatataatgaccaacaagacaaatacacctcttgtgcttacagagcttacagaacctcaagagaaaaagacaaaatagtaggtaattacaataaaacgtgttatgtcctaggtgctcctcgtgcagtctaaaaccacaaagacataaaattatttgaaatagtcaaaatgtggaaacaacccaaatgtccatcaacaataatcaatttgtttattgaggcaataaacaaatatgtggtatacccatacaagggaatattatttagccacagaaaaaaaatgaagtactgatacatgctacaatatggatggaccttgaaaacatcataattaggaaaaacgtcagacacaaaaggccacatattgtatgatttaagttatataacatgccccaaataggcaaatccacagagacagaaagcaagttagtggcttccaggagctgggggatgaaagagaatggggaatgactgctaacaggtatgaggtttcttttgggggcaataatgttcttaaattagatagtggtaatggttacacaatcttgtcaatataccaaacgccactcaactatacactttaaaaaggtgaatgctatgatatgtgagtcatatctcaaaaaagtagttacttaaaggagaaaaaatccacaaaccctttaatacggtaaagaaggacccacctgagccgtatagaatcaactttccttgtcagaatacatgtggtataagagaagcatgactttagaatcagacagactactacctagcttttcaccgccatggtttcttaatctgcaaattaagatttgtgcaatgttgttacgagtttaaaaataacatatcaaagcatctgttgtaaagtagcttctcaataaacaatcacccaacgatgttatggaatatcaatattaggaatttcacaactagggtgagacttctccaactctttaggccagcagaatagtttccaagtggatggtatccagcagggtgattactagattgccctgccgccaaaatcaaaagcagaaccatgatggcacgaggatgtgaagtggaacctatcaagcgatcgatgctgcctcttctccaccacgggtcagcattaaaagatcatctcttcctaatttatgagcatctcagtccatcttggagactccataaaatgtgtacctttggagatttttaaatctcctgtctttcctcctgtactttggagactctatacgctgactaactgaaaagcagaactacaagaactaaatgcttcatacctgcatcatattggaaagaccctgatcaatttcaataaaaaccccttgatgtatttcaattgatagacagatttttctttaaaatatgcaacatgtgatagggggaattatgtttacactgcatcaaaaaaaatcaggtaataacttcatttgagacctccttatagaaaatatattcctcacagagcgtggcataattgcaggcacacagttaaagctcagtaaatattaatactttctgcaatgaaaagacattacataacaaaccagcaactggtcaagaaacagaaatgcctgttatatggattgttctttcctactaaggatgagacatccaaagacctctgtgatgtggctcctgcctgtctctgccacattgtgtctactctcatcacaacgtactagtctgtcaacacactgaacctcatggagttctctaactgcacctagaagttcttgcttctaggcccttgttgacgctcttcccttgcctagatctccctttccccatttctctaccagcttaactcttacaagtcacctaggattcagctcccgtgtcatctacttaggaagcctccctgatcttgccgagtcctgccccttggtgtggatgagagttccctcacacacacttatctagtacctgtcatattgttataacaactctctgtttagttatttgtttcccatcctaaactgttggtttctagaaggtggaatcatggctttcaccgctgtattgttatctcctaaaacagtgccaggcattgaataagtgctcactgagtgagtgaatgaatgactttagtcatagttgtattcagcattttattgaaataattttaactattaccaacttctcaaatttcctcaacattttaaacttaaagaaacatgatcatatttgataagaaacatcactaattacatttaaataaaacccagcacaattatcacatgtaatttacaacagttaatccaattcatacttaatgatatgaataattactatagtgtcaaaagttcattgggcataaaagtcagacagtcaacataaacaaatattaaaatgttccttttatttaagccaagcaaatcattcttggaattcactgagggaagagagaaaaggaactgagcagggaaggaaacaactctgccagtttccttaattagaaactgaagttgcttctgaggcaggtcattctatatcctgcactttcaggggctaagggttacaaagtgtccttattcttacccgcttccttgtttactcactaaccctaccacttgcccaaggaaagaatggggagaagttggtcagtgctttaaacctcccctcaatccttctcccagtcactctaatgggttttctttttaaagccctaagtctgagagttctcaggtgacattcaattgttcaagtgacaggggagtccattccagcattaagagtgatatacaggccgggcgtagtggctcttgcctataaatcccagcacttcgagaggctgaggaaagcagattgcttgagctcaggagttcaagactagcttgggaaatatggtgaaaactgtctctaccaaaactacaaaaaattagctgggtatggtggcacacgtctgtggtctcaggtgtctaagaggctgaggcgggaggatcacttgagcctgggagacaaaggtggcattgagccaagatcccaccattccactctagcctgggtgacagagcgagactccatctcaaaaaaagtgatataaggcagggtacagtggctcacatctgtaatcccagcactttgggaagctggggaaggtggatcacttgaggtcaggagtttgagaccagcttgggcaacatagccagacccctagctctacaaaaatataaaaattagcagggtgtggtggtgtgtacctgtaatcccagctacttgggaggcggaggtgaaacagtcacttcagcccaggagttggaggctgcagtaagctatgatcacaccgctggactccagcctggtaatagagtgagaccttgtctcaaaaaaacaaaacaacaaaaaaagtggaataggtagctggatgctttaacatactcagaagtggatcaacttctcaactagagaatgccagagcaattcatctataaaaatcctgtacataaagaaggtcgaacatctgaccaccagagcaacaaacccaggaatcatgagggaaaacaaagcattctttggctttgtcctgatttttcctctttccctctcagataaacatcaaaatcacatactggcttcaattccatgtgtcattcacttaatataatcccaaaagtcatctattactgagaggtgacaccatgctggcagccctcacagccctcgctcgctcttagtgcctcctcggcctcggtgcccactctggcggcacttgaggagcccttcagcccaccgctgcactgtgggagcccctttctgggctggccaaggctggagagggctccctcagcttgcggtgaggtgtggagggagagccctgggcgggaaccagagctgcacgaggtgcttgcgggccagcgtgagttctgggtgggctgggcttggcgggccggcactcggagcgcccggccagtgccgctggccccgggcactgagggtcttagcacccaggccagcagctgcggagggtgtgccaggttccccagcagtgtcggcccgcccgcactgcgctcaaattctcccggggcctcagctgcctccccgtggggcagggctcaggacctgcagcccaccatgcctgagcctccctggtgggctcctgcgccgccggagcctcctggacgagcatctgtccctgctccatggggcacggtcccatcgaatgcccaagggctgaggaacacaggcgcaaggcagcctgggactggcaggcagttccacctgtgcccccatgcaggactgggctcagaagccaactgggctcctgagtctattggggacttggagaacctttatgtctagctaagggattgtaaatacaccaatcggcaccctgtatcgagctcaaggtttgcaaatgcaccaatcagtgctctgtgtctagctcagggcttgtgaatgcaccaatcagtgctctgtgtctagctaatctagtggggacttggagaacttttgtgtctagctcagggattgtaaacgcaccaatcagcaccctgtcaaaacggaccaatcagctctctgtaaaacagaccaatcagctgtctgttaaatggaccaatcagcaggatgtgggtggggccagataagggaataaaagcaggctgcggagccagcagtggcaattctctctggttgttttccacactgtgggagctttgttctttcttgctccttgggtccgcactgcctttatgagctgttaactctcaccgcaaacatctgtagtttcactcctgaggccacggagaccatgaacccactgggaggaataaacaactgcagacgccctgctttaagagctgtaacactcactgtgaaggtctgcagcttcactcatgaagtcagggagaccacgaacccaccaggaggaagaaactccgaacatatccctacatcagaaggaacaaattctagacacattacctttaggaactgtgacacacaccgcgagggtccgtggctttattcttgaagtcagtgagaccaagaacccaccaattcctgacacgttactgtggagaatttgcagtgcacagaaacttgttcaagactgtgctctttagtactagctgcctcccaagaaaggagcaaacagtaacattgtattacagatgctttaaagagagagaagagggcagacccagtggctcacatctgtaattccagcactttggtcaggcaaggagggtagatcacttgagatcaggagttcggaccagcctggccagcagggtgaaaccccatctttacgaaacacaaaaatcagctgggcgtcgtggcacacacctgtagtgctagccactcaggaggctgaggcaggagaattgcttgaacccaggaggtggaggttgcagtgagctgagactgggccgctgccttcccgcctgggtgacaaagtgggaatctgtctcagaaaaaaaaaaaaaaaagagagaaaaataatggttctctgagctcttaaaggtcgtaagggagaccttcaaatttagggaaagaagcagagaaaggaaaggagaaatcaaaaagaggactggaccttctccctctgcattcaggtttttacaaagagaaggtaacaggtaattctgcagattctctagaggccattttatgtgtacacacccattggttggcaaaaacaagtgtcaccttcagaaatatgttggtcattaaaatgaaccgacccaacagatttactctgtgttcactaatacctataccgtatttcaaattaggcatagatatctgtctttttaatactttgaatagatttcaaatttgcctaccttattgaactcacggtttaatgattgtggtttgatatgaataaggttattttcagcatatttttgtgatttttttgcattctttttattagcatgagacaggcattctattttgttcatttaaattatttttaaattagccttatgcaggcttggtatttggggtataatttggactcccacacatcttaattcatctgggatccaattaaattattttgatattccaaaatacttagcttctactccctcacttttcccttcccaacagttaatctcttatttatatctaccgtgtaagaaaggaagttaggtcaattaaatacagtgctggaagtgtagtcaaatgaatctgttctgttcccaactgacattccaatttgcatgaacttggactcatcaccaattcatctgtgtctgtttcctcatttgctaaagcgaaatactgctattagtggtcttacaccctagaatcaagaggaagacacttggcacatgtctcggtagaatgaaaattccttgagagtcactcattttttaacactataaaaactagtcctttatcctctccacctaatccaatgctctagagggcagaacaaaattgactaattttttggcttacttggtttgttttctaagacaagtaaatataaaactccctacagagagctattcatacaagtttttattacataagtatttctgaagtaaactgtgctcaagtagacacacataacactgacttttgttttgttttacaaacagcaacaacgtgaaaagtccactgaataatgaagaagaatgacacactggttacaagatgctactgaaaaatatgccacattctgttttctcctgttggagcttcactcttcacatttgtatattaaagatttcaaggaatcttggattaaagaaatcatgtttaacttcgctttactccacatttattagatgacaaaattttttacaaagaataataaataacatcctgaggaacaaacttagggaaagcttatcataaaacaaatagttaaagatggactataccattgagaattgggccttttctggtagcttaggatgaataatacacattttacatacttttcttttatccaaaatagcattttattttacaaaagtaatgttcttccaaaacctttttaaatgcaaataaagaaaaataactaaaaacaaccataatcccacctcttagaataaaattatacttagcattttgatctacattgtatgcgcgtatccatatatatatgtgtgtatgtccattttcttaaccgagttaagaatagagaatattcactggaaatctacagcaaaagttttatgtaagggtaagcctttgaggcatttctttaaaatcaagcacagtacatgttttctactattgtagatactattgaaagctacactgaagtttctagtcaattaagaaaaaagtagaagatataaaacgaagttttgtaaactatcattgctaatggatgacatgatcgtccattcataaaaatcaataaagctacctcctgaaattttttttttttgagatggaatcttgctctgtcacctagactggagtgcagtggtgcaatttccactcactgcaacctccgcctcctgggttcaagtaattctcctgcctcagcctcctgagtagctgggattataggcatgcgccgccatgcctggctaatttttgtatttttagtagagatgggatttcaccatgttggtgagtctggtctccaactcctgatccgcccacctctgcctcccagagtgctgggattataggcatgagccaccacacccagccgaaatatttttaaaatcaggtaattaagcatgtaggcaatattaagatcaacatacaaaaaatcaaagacctccatagtggtcataacaattacaaaatgcagtagaagaaagaagctattcacagtagaaacaaaaattaaaaatacaaaagtgtttaaatcactcatggacaaaattacaaaattttgttgaatgatataaaataaaacttgaatactggaatagttcgtattcctgggtaggaagactcaaaactgttgcgttgtcaacttttcacaaattaatctataaattcatctaaattacaatcaacatttcaacagaatttttcagtagtcatacactcaattctaaattcatatgagaggttaaatttgcaagagtagtcaagaaatttaaaagaaaaagggactcaaaaggatggttgctttcttgccaaatatcaagacatagtatataactatggtaattggtatattgctattttggttacaaagaacaactaagtaaagaacccaaaacccaactcataaatatatatatataaatacattcgaaatatattcaaaaacctttaatatgatagattcagcattcaaaaccagtagaggaaagataactattcaatataatccaaggaacaattggcaatctataggggagataaagctagatttctgttttatggaattcacaaaagctgatttcaaataaattataagcataagtgtggagaaaactacaaaatatttaaagtgaatatagaagaatatgttaatcccttaggatgtgataggccttaaatcaagtgcaaagagaaaatcatgaaggaaaaagctaatgaatttggtagcataaaaattaaaatcttccacaagaaagaaaacaccacaaaaaaattaaaaaagtaatttacttgaagaaatattagcaatttgtacagcagaaaaaggactggtaattatataaataacttctaagaattaaaagtaaaacacaaataaaccaatagatttatggcaaaaaaagataattcacaaaaaataacatacaaatacccaatacagatataaaaatatatgtaacagcaaaaataaatttgttagataagatgaagtagtataaatctcagttgtgttagtccattctcacactgctacaaagatactacccgatacttgataatttatcaacgaaagtggtttaattgactcacagttctgcatggctgaggaggcctcaggaagcttaacgattatggcagaaggggaagcaaggcaggtcgtgcatggcggcagaagagagcgagagaggggaagtgccacacttttaaaaccatcagttatcatgagaacaaactcactatcacaagaacagcatcggcgaaactgcccctgtgatccaatcaccttctgccagatccctccttcaacaagtggcagttacagttgaagatgagatgtggatgggaacatggagccaaaccatatcaccagtcatggttttcagagacagagacaacttgcagaaaaacgcctacaatacgataatgtttacaaaagtaaacacacatccaaatagatgtacaaacaataccatgcacattctatgtacatgtaaatgtatgtaaacattttcatggaatagggttaggaggagcaggtagacagtagtaggattgagtaggagagaaagatgacttctctgtgataatttgtcttcctttaaggataatgcttttattatttaatttcaaaacaatgtcaaaatattcaaaaaaatctcaacaaaggtaccactaaggatagaatatcaatgataaagagaaggtcttaatagccttcaaagaaataaaaagttttctacaaaggaataaaaattggactttagtgttttttaaaatagaaacaacaacagacattaaaaaagatggaatagcaaattcttctgttatgaaagacaatcatcgtaaacctaaaatggaatattaatccaaacatgcaatcaaacttgagggcaaaatgaaagctttctcaatcacataggaaatgccatgcaacacttctgtggaagttacataaggatgtacttcaataaaatgagagagaaatcaagtgaaagaaatatgtaggacactagaaacggtgacactaactcaagattccatgggaataggatgggcagtacaatagttaaacagcaagcacagaaaaaacaaaaaacaaaaaactctgcatttaaaaaaggcagatggctccaaattaaatatatgtatgaagacaaaattcatttcaataagtaaaaagtaagttactagcagatattaagagtattatttttaaaagaaggcctataattctttcaataataataaacttaatagaaaactttagagaaagatacaagcaaacacacagtgctatcaatgagatgtggtccaaatatgaagcagactaaactatggtttgattatgagaaactttaggagcataagaaaggatgctagaaatactgtgtttcaagtgacttatggttcgtacagaaaaaaaagaaaatgaaaatgaaaactttgtataatatttacctctaataaataaaatttaaataattataataatataaataaggtttattgattttcagccgttacaatcaagtttttttctgtcaaaactggaggccaatcgtttctaaaattaaataatagagatagtggcagcagtgacagtggcagttgcactgatgacatcaccacctaggtggcatcatgggtaaaatcaagcctcagtggcagtgctccaggttatgggctgggataatcaaaaatgagcccaaccttagagctacagtccaggtacagatcaacttaacagtgaaaattggactagttcctatctcacttaagcagcaagacatagaaactcctactgtctgtagaaaataaagtagcaggattcccaattcttactgttcaagacacaatattatatattcaaccaaaggttaccaaacatgcaaagaaacaagaaaatgggagccaaagtaagaaaaaagtcaacttaaaatgacttgcatagtgacccaaatattagaatagcaaacaagatctataaaataatatattcaaggatttagagaaaagtatggaataagaagtaagcagacagggccgggcacagtggctcacgcctgtaatcccagcactttgggaggccaaggtgggcgaatcaccagaagtcaggagttcgagacccgcctggtcaacatggcgaaaccccatctctactaaaaatacaaaaattagccaggcgtggtggcaggcacctgtagtcccagctactagggaggctgaggcaagagaatcacttgaacgcaggaggcggaggttgcagtgagctgcaatcacaccactgcacactctagtctgggcaacaagatccagactccatctcaaaaaaaaaaaaaaaaaaaaatgaaagaaagaagccagacagaaattttaaataaactaaatagagagcagagattttataaatatttaacacaaaaatatattaggctgacttaacaaaagaataacattgttaaagaacagaacaggaactggaagataaatatatagaaattatccaaaataaaatttggagagaaaaaagtatttaaaaagattgaacagtgaattatcagtgacatgtgaggcagtattaaatggtattacttccattttactggactttcataaaaagaagcaagagagaatgaaaaggaacaaattgaaaaaataagagtgacaatattttccaaatttcatataaaatttaaagccataaattcaaatttgatagaaattttaaactcataaatccacaaagctctaggtaccccaaagaggacaaatgcacaaaaatccaaacttagaaaatcataagcaaatcactaaaaaacaagggtaaaatattgtaaaagcggtcaaaaggaaaatgtcacatggagagtaatgattatagtagaaatgctttcttctcaccaaaaacagtacaagacaaaagataatggaatgacacttctaatgaccatcaacctatagttctttattcagtgaaaatattcttcaaaaatgaatttgaactaaagactctttcccagttaaatgaaagctgagaatgccagtgtaccagtatgaacagaaacggtaaaagaagttcttcatgctgaagaaagctgatatgtgatgagaagtaagatctaaagacaagattaaatgtaccaaaaatgattaatattgtcaaatcccaaatattttaatacaataatggtgacgggtaaatcaattatatctctactataaaggttaaaagaaaaaattattaaaaacaactaacataacaataatttgttaagagatacaaattatttaaaaatgtaaattgtgacatcaaaaacaataaaacctgggaagaaggggaataaaaatatagagtttgtgtatgcaatcaaagttaagtttttatttgttaaaataggcagttatatgtataagatgctttatgtaagcttcagggtaaacaaaatgcaaaatactataattgatatgcaaaagataaaaataaaataaataaaatatatcactaaagaaagccatcaagccacaaagaaagaaagcaatagaggaagaaaggaaaaaaggatttatacaacaaccagaaaacaacaaaatggcagcagtaagtcctcacatatcagtaatcactttgaatgtaaattaattaaattctccaatcaaaaggcatagagtgactgaatggattacgaaaacaagacccagctacatgctgtctacaagaaactcacttcaccttaaaggacactcatagactaaaagtgaagggatgagaaaagacattccatgcaaatggaagtcaaaagagaacacgtgtagatatttttatttcagacaatatattttaggtcaaaaactttaaaaagagacaacaaaggttattatatagtgataaaggcatacgttcatcaagagaatttaacaattaccaatatacatgcatccaatatcagagcacctaaatgtaaaaagtgacattaagagatctagaagaagacatagactagaacacaataatagcaggggattgtaataccctactttcaacaacagactgattatccagacagaaagccagtaaggaaacatgggccttcaactatacttcagaccagatacaactaacagacatagatggaggactccacccaacagaatacattcttctcaaatgcacacagaactttcttcaggataggctatatgttaggtcacaaaactagttttgacatgcttaataagatcaaaattatatgaaattattttctgaccacaagtataggaaactagacatcaataagagaagaaatcatggaaaaagttaacaaatgtgtagaaattaaacaatattctcctgagcaactactaggtctaagaagaaattaaaggagaaattttaaaatagcttaagacaaataaaaatgaaaacaacatatcaaaacttatgggatgcagcaaaaacagttctaagagggaagtttatagcagcaagtgcctacatcaaaatagaaaaaaaaaaaacaaaaaacctcaaatagacaacctaatgttatacccaaggaaatggaaaaagaaccaactaagcccaaagttagcagaagaaagaaaataataaagatcagaacagaaataagaaaatacagaatagaaaacatcaatgaagctaagttggttttttaaaaagccaaaaaaaaactgaccaatgtttagctagactaaataagaaaaaaagagagaagcatcaaataaataaaatcagaaatggaagaggagacattacaactgacaaccaataaatacaaaggactagcatgaacaattataaaccaatcagttggagaactcacatgaaatggatgaattcctagaaacatataacctaccaggactgaatcacaaataagttagaaatctgtacagaccaataacaagtaaggagattcaatcagtaattaaaagtcatcaacaaaaatctcaggaccagatggcttcccagctgaattctatcaaacatttaaagaactaaaaccaatccttcctaaacacttccaaaaagttgagaaagggggcccaaggcagatgtttcactgaacccaatgacacatgaatacaacttaaaagtttattttaactctgtctcagaagaaatcgttttgcccctcatatcaagtagattccaaatatatagtagtaaaactttaaaatcaaatatttttaaagttgggcttgctttattagcatgaaaaatgtttaattaaatcaaattaatgagttaattaacaattattggatgcaagggcatatactcaatgctatggtagataaaagttacataaagcaaagttcctctccttaacagttagcataaaatagtactggctcctttattcatagtccttttttcagataatttttcttatatctgctagatgtgtatagtaagaatagaggaagttaaagtacatcttacatttccaatttgtgactttttgacacaaactgcaaagaaagtagttatgtggctatctatggagtaccctaagaggtaaaccccatcaaataccaactcagacacacaatagagtatatcatgtgtcatttaatgaaagggatatgttctgatatgttggctgattttgtcattgtatgaacgttatatggtgtacttacacatatctagatagtacagcctactacacacctagcctatgtgctatagcctattgctcctagctacagacctgtacaatatgttactgtactaaatactgtgggcaattgtaacacgatggcaagtatttttgtatccaaagatttttacatagaaattataatcttattagtcgttttctattagcatgaaaaatggcaattaatgtcattatatgatgtatgactgtacagcatagaagaggaggtttttaaattaaatagcatcaagcatgtgagggttaagcagaaatagtccccaaattactgcatccaggaatagggcacacatgcttttacccaatggggcattaatttgaacttggaacacaatcaaaatgggatttttcctgtcaaaagatgttttaaatgctctattaatacattcagaatactattgataacagaggacacaggtgactgtgactgacattggggaaagggcatcaagaccaagcataaacataaaaacgtcctcaagattatgaaagagcaataaacactttgccaagtctattggtaggaccaagcaagaatataaatcaattaataagaactgaacctaatataaacttggagtatcctaagatgaagaacctaaggaacttccccagatattttgagaatcctaatataaatacgtgaccaatcccagagtcaagagcaaggaaacaataagaaaaagagagagaaaaggaataaaatggcaacattaggagcattgtggacctgcttctagataaacaataatgacttataaaatttatttttacaaaaacaacaggaagtatttagagtctctgtaaattgtcctaagcatatacagcaaaggaagaaatatttacacaatattatctactaaacatcagtaagaacagtgacagtctgtggcacgtaagccacaatccactcctttactgaactccaacctccagctcaagatgacagaagttccactctgggtagacaagaccaggaggcaaggatccctttcccacagcaacagtcaagtgctaggataggacccaaggagaggtagacaaccagcatttctcgggacccccatctccatgtcacagagactaaattccagtctagcagtacagcagagaaggaaagggctgtattttttcacccaccttccactcatagagcagaggctctaccttagatgtggcaagttgagaatactaggattctaatcactcttacactgtctcatttgtagggcagaaggtccatttagagagaagcaagtaaagggaccagaggctatgacactggcccctcttgtaaagtaagggtgctactcttaaataaatgggccacttctatttctggagcagtggctcaaagagtttgtccagaaagagaggcaatccataataacatagaactctgaaacacttatcaaaggaactggctttatttggaactaaaaatgggaaagttcaagcctaatggtgcactgaaaacaaaaattgatattttgatggaaaataactcaggtgaggctggcacttccatgagaacatcaggctaaactcttgttctgttagttcatcagagagaatgagggaaagaaacagctaagtagagccttcctggaatcagaacacacctaaagattggcctcagaaaccgcctttgcaaaagagtctgaatttatttggatcggaagatgaagcaacttatgccccaggataattagtgtagcctaacagttggtgtgataccaacagaagcagagagattaacagagagatcatagacagaaacaaagagaaacctgccaaaaccactgtcaccacagagtcactgtatgcattcccaaggctgaacttcgtgaggcatgacatcagtcttcaactttggcagaaatagactttactgaaatctcctagccaagtcaaaacacacataaccaagaaagcaataacaatgacaagccctagaggagaagaaggatcaatgtccagagctgttaccgtatattacccaaaatgctcaatttgcaacaacaataaaaattatgagatgtgaagaaacaagaaagtgcaaccaatatacacagaagaaaaagcaggcaacaaaatctgactaggagaggggtaagatatccaacttaaagacttcaagatagtcattataaatatgctcagagaactaaaggaagcatgctttacaaagtgaaggaaggtatgagaacaacgtctgttcaaatagagaatatcaataaagacatagaatatataagaaagaaccaaatggaaattctggggttgaaaaatacaatttttaaaaattcattagaagggctcaaaacaatagatctgaacaagcagaagaaataatacacacacttgaagataatttgacaaattctggggttgaaaaatacaatttttaaaaattcattagaagggcttaaaacaatagatctgaacaagcagaagaaataatacacaaacttgaagataatttgacatattatgaaagccacagagataaaaaaagagtaaagaaaattgagcagatcataagagagacatggaacaccattaagcacaccactataggcaaaatggtagtaccagaagaggagagagatgagcataaaaatatttcaataaataatggctaaaaactacccacacttgacgaaaaacaatactgttcacatgcaagaagctcagtgggtaaatataaagagattcatacccagaatcatcacagtaaaaatactgaaatcaaagacaaagagtaaatcatgaaagcagcaagagaaaaataatttatcatgcccaaggaaacctcaataagaagaatgactgagttctcatcaaaaactattgagaacctaagtggttggatgacaaaaacgattaaccaaaaatcttatatccaacaaaattatctttcaaaactgaagacaaaacaatgccattccagatacacaaaaattgagagaattttttcctactgaacccacttaggaaatagtaaaaaaaattccttcagggctgaaaacaagtgggccccagacagtaacttttagttttacacacacacacatacacacacacacgcatacacacaagcactggtaaacataattatgtaattctaaaggatagtataaatgaatagttctcctttcttctcttaaatgatttaaaaggcaattgtatataataatatgtataaaatgtattgttgggcctacaacatatacaaatgtaatctatttcacaataacagtacacaagtggtaggtgggagcaaagttgtactgtagaaaggacatgataccagatggtaactcaaatccacagaaccaaatgacgactaccataaagggtaaataagaagattaatataagaaactctctaaatactcaaatttctttcttatatcttcttgaaaggatataaaattatataaagtaataagtataacaatatatggttggatctgtaactcatataaatatgtataacaataatagtatgaaaagcggaactaggaaatagagctatacagaagtattgtttccgtatctcactgcaattaaggtgatataagtatatagtaaatcaaaatattaagatgttacactagaaaatattaaattaatacaaaagaaagcaataaaagagaaatataagagcaaaaaagacatgagaccgtattttttaaaagtaaaattgcatgtgtaaatcactatatcagtaataacattgggagctgatcataatccccaaaacccaatcccaaatgccataatccctaatattgaaattccaaaagctcaaaatcccacaaatctaaaatctccaaaatcacaatcttgaaaagtcaaaattataaaaaacataattctggaaaaaaataattttaaaaattaccttaaatatatttctttacatttttaaaagaggatttattttagaaacataaaaatacaacataacacttcataggacactttacataataaaatagccaataatatatatatttttgcaagcataaacactcaggtatactaataacagtcacatgagtataaacgtatgagcagatgaatcatacaaaaaaataggtcaaaagggaaacgcatttgcatatcactatggttggtaatgctgtgcacccagctttattactgcagtcatatgaaacactatgatgaataatttgtcttttgtcgagattgatcaaaaactaaaaattttcactatcgcatatgcagtcaccgaaataaccaaaatcttgagaaatgttatctttcacaaatacacatgtacataaaggacatctcttcatttattgaggaagtttcaacatttttacatacaagcacaatgcttacaaagtcaaccttgtgataatgcacttccttggagttaaatttgcaaaaaatgcacaaaatgcattagaactctccaagtctctacggaatttatacctccagtattggagagaatacaaaaattaaatacatgtcatagtgaactgtaaaaaacaatgctgacaatttaaaatagtttaaaaaaagaaaaaaatcaacatccaaaaaggtgtattacagagatagattatggacaattgcacagaaatactccataagagctggccaacattcacgataattttgaaatcttgcatcatgaggatcagctacttttttccttttaggttttggctctcctgagagaatatattcacacttatttgctatgtggtgctgctccttttgaaattcttctatgattcaataattgctgacgtgagcattccctattaattttaccatcttctatttaagaattttgatcttttgggattatggcacttgggattgtatctttcaggattattatccaaatccaataattctaaacgcgagtaaatgaacaatcaagacaaaaggaaaaaattgtaagactagatttaaaaacccaagacacagttatctgtaggttcactgcaggagatgtatattagattcaaagatacaaatctgatgaaagtaaaaggatgcaaaaagatatatcatgaaaacagcaaccgtaaaaaagctggaaaggcatacttaagacaacataaactttaaaacaaaaaatattgctagagataaagagggaagtataataataaaagagtaaattcattaggaagatattaattttaaaaataaatatacacttagaaacagagctccataatacatgcaacaaaaactgacagaattattgggagaaatacacaatttaacaataagtgttggagacttcaatattctactttaacaatgagcaaaacatgtcagagaagatcaacaaggaaatagaagacttgagcaagaatgtaaaccagttaagacctgaaagttttctatagaacactccacccaacagcagcagaatacacatccttgtcaagtacacatggaatattcaacagaagagatgatatgcaagaccataaaacaagtctcaatacctttgaaaggatggaaatcatactaagtatgttctctggccacaatggaataaaattagaaatcagtaacaaagaaatttgagaaacttgcaaatacgtggaaatgatagcacacactcctaaataagaggtcagagaagaaagtacaaggaaaattagaaaacactttgagatgcatgaaaatgaaaacacaatacactaaaacttacggaacactgctaaagcagagcttagaatttacaactataaatgcctatatgaagaaagtttccagattaatgtattaacctcctaacttcagatactagcaaagaagagaaagtaaacataaaacaagaagaaagaagaaaataataaaagttagagcataaattaataaaatgaaaaaacgcagaaatcaaataaaagtgtgtactttgaaaagatcaaaataattgacaaatatttagtttggccaagagaaagaaaagacctaaattactaaaatcaggatggaagtgggggattactactgaccttaaagaaaataaaaggtttatacaagaatactatgaatgactaaatgccaaaaaattaaataacttagataaaatgggaaaatccctagaaagacaccaactgtgaaaactgagtcaaatagaaatagaaaatgtgaatacacctataacaaataaaccctcagcctaaacagcttcactggtgaattctatcaattatttaaagaataaataatgccagttcttgacaaacatttccaaaacagaaaattagagaatactttctaattcattctatgagcctagtattacccgaattccaaaaccagacaaggacatcgcaagataaggaaactacacaccaatatctctaatgaatatagatgcaaaactctgcaacaaaatactagcaaactgaatccagcaatatactaaaagaatcataaatcatgaccaagaggcattaatctcaggaatgtgacgttgctttagcatccaaaaatcaatcagtataacatagaataccaatagaagaaagaataaaatccacacaattatctaaattgactcagaaaaagcatttggcaaatctgacacatttttatgagaaaaagaaaaaacactcaacgaacaaggaatagaagagaacttcgtcaacataataaaaggcatctataaaaaatcgcaccaatgacatcatacttaataaatggctgaatactttccacctaagaccaggaaaaagacaagaatgtctagtctcacgactttgattcaacattacactggaggttttagctagggcaattaggcaagaaaagttagcgggggagggccgggcgtggcggctcacgcctgtaataccagcactttgggaggccgagacgggcagatcacgaggtcaggagatcgagatcatcctggctaacgcggtgaaactccgtctctactaaaaaatacaaaaacaaaattagctgggtgtggtggcaggtgcctgtagtcccagctactcgggaggctgaggctggagaatggcatgaacccagaggctgagcttgcagtgagccgagatcgcgccactgcactccaggctgagccacagagcgagactccatctcaataaaaaaaaaaaaaaaaaggaaaaaagaaaagttaggagaggagaagcatctaggttgaaaggaagtaggaaagctatcacaatttgcagattacattatcttgtttatagagaagtctaaagaatcaactaaaaatcttctagatctaataagagttcagctacgttgtaaaataaacaaaatacaaaaattgattggatttctatacacttgcaataatctgaaatgaaattgagaaaacaattccattacaataggatcaaaaaaataaaatacttaggaataaatctcctatcaaaatcccagccgactcccttgcagaaattgatgaggtattcctaaaattcttacagatgaatcatccaaaacaatcttgaaggaaaagaacaaagttgaaggactttgatttaaaaatgtattacaaagctatgctcttcaagagaatgtggtactagcataaggacagacatataaatcaatgaaatagaattgatcatgataataaaaatgaaaaataataacaagtgttggtgaggatttaaggaaattttaacccccatacacagcttgtaggaatataaaatgatgcagccactttggcaagcagctggacggttaccatatgacctaggaatttcactcctgggtatatactcaagataaatagaaacatagtcacatacaaatttgcacatgaatgttcatagccacatttttcataatagccaaaggtgaaaacaacccaaatgtcctacaacccataaatggataaacaaaatgtgatatatacacacaatgaaatattgttcatccataaaaaatgaagttctcatttatgttacaatatagaagaatcttgaaaacattatgctaagtgaaaacagccagacacaaaaggtcacatgttgtatgattctatttttacaaaatatacagagtaggcaaaactttaccaacagaaagcagattaatgattgcctggaacttgcagagttagaaaggaaaagagggtgcctgctaatggatgtgagatttctttttagggtgatggacatattctgaaatccttgatgtcagtggtggtgtcacaactctgaatataccaaaaaaattgcacagtttaagtgagagaatttcatgatatgttaattatagctcaataaagctgtttaaaaaaatgaaagaggataaaaactgtacaatgcaccacacctcccactattttgttaggtaaaactagctttaaagcaaattccctatcatacctcctgtatgatttgctgaagttatgtattttgtgtttatatgtaagaacctatagttcctatagttctcatttacttatttacccatcaaataatctgaattacttatatatttttctaggaagagtaaataaaattagagaaagtaacagtgcatggctattattgaaagttatgctcttctgtttcatagaggttgctctggaaaaaaaaattgggcaagaatagaagaaataggctaaaactgagatatgatacagcttccaatgacaaagaaggagccacctgaaacacatttttatttagcaataatgtgatcctaaaaggaaaataccatttgaacaaaccaaatagcccctccactaggagaggagattcacctcccacttgactccccagaagtggatttcacaagtttacatgcaacccagaattgagcgacattatcttctcacaataaaattgtgggccttaagtagtccatttttcatcctgccagccagagattctattgatgaaccaaataatagagaaaaacgtggacagtctgtggctgcttccttttcaaaaaagaaagaaagaaagaaatggtgtccaattatacacattagccttaattttggcctttgaatgatcagataatgtttctgcccatgaaatgaattcttgtggcaagcccatgcttttcaatgtcaaaaataaaatcttccaattaattgtcaaaacgcttttccagcatctggagacgggagtaagttgggtcttttatatttgtagcttttgacattatattaaacaatctttcgggttgtcatagtccattctcctttgtatatatccccattggtttgtgtttatcaattgttttattaggccatctaatctttcagttcaatttctatatttcttatatttaggttaaatcaagggaaatttttgtcactgtgcaataatctccatgtcctgcttcaagagggcaagaccaaggatatttttcagagtgtaggcagatatttgcctttccttcctccaaaaagctggtcctgcatggggttacatgaagctgtctcagcactggcaaccatagaagataccacgtagacaactaatcagctattgtggattgctataatctttaccgcaaggtaaatatcagagctactgatccatgcttatgtacttcttttcaagtctgagagtgtttctctttaacagaaaatgctgcatgaaaacactttccatttcccagtatcttctctcaaggattttctttgttttacatttgaaaaggtaatcaagtcacataaatgagctaaggatttttcatttgctcttaactccaaaacttttcaagaaaagttggaagcagagaagcttctttttcatttcttcatatgttcatatctagggctattttttcatttgatttctgttttccttgctcctttttttgtaagaatgtctgcatttaccaaatttaacttgtgttccttttggattcatagaagcatatatttttctttaatcaatgtctgtgttccctgagaagctaaaaattattccaggatgagggtattacgtattaacagaaaaaaaatagagaaatcatttgtattcatttttcaaaatacttctcagcccaatttagaaaggctttactttcttggatttgttcatttgaatttttaatcattaatttaactcaactatgcagatgatcaaccacagagatgtagaaagaactggagcaattgtacctaggtaagaaaaagggtgattcatttgaaggaggtgagtaaagacagacagtgtgttgatacaagcttcttgatgccctttctaccaatctccaggcacttcttggctaaggcatgtaaataattttcacttgtcctggtccttcttttagggacagaacaagccttatcagcctatcagcaaattatttacacccagtttcaggtctcctgggcaccaggatggacacaggcatgtgtgtccttaagagctgcaaatctgtatccaaaaggagttatagatccaacggcaaagaaaagtcataagtacatatgggaatggagccaaacctgagaaggttggaaagtgttcaggaactaaatgtaaagtggcagagaattatcaggctgatggaaaagccatgaaaaagttgagatgacacttgtatatgtacatggctgcatcgcctcagggtagatgtggggggcaaaggaactagacacgaccaccctaccctggacctctcctcagtcccaacactcagagcagttccctcagcaagcacttggcaccaaaaggcaaagcagtctcaggtgctgtggcttgctctctctgatcctctgtcctgctccataagatagaacttttcacatactttaggagccaagtacaaatattctaacccctaactgtaatttcctgttctcatcagtcacttaaaccttgatgtccatgggacaccactctaaattatctgcattttaaattgtttttatgattttgttctttgccctgaaattttctttacattcccattctaagagaggctatgttggttgaaggtccattcagtcttctacaaccctttttccactctttcacccttctgcaagtccctaaccttccaaaagagccacctaagtttcgaccttctttctcctctaaaaaataaaacaaaagtgttaatgatggtgatgggcaaagttgaaattatttaatatctcaataattatagctccttcaagccttttaaaaggaaatattcagcatttgtctccagcaatttagattatggttcggaagattagttaacatcctattagcctgtaatcctaaactattctttactctaaagtacattaaatcagatgggaacaaaaacccccacttttctttacattttcattttatgagataggtctttgggaaaatttatatttactgttttttcaagttatgcttgagcgctatggatagcttctacataggtttaggttgttgaaaatgaagaaaatgatacaacagctaacatctattggccacttagtatatgggacaagcactttggtaagtactgtattacatggactatctcatttaagtcccacaacaactattatcctcatttttatacatgaagaaactaaggctcacagaaattcattaacctgcccaagagagtggtatagccaaaactcaattttattttgattaagggaaaatttaaagaaacaatgcatgtacaaggatatgactgcaaatagtgataagctgcatattgtgctccagtgccccatgtgagcaaactagtggcctggaagcttctctgcatagtcatggaggtaagtctcttgatttaaggatgtcataataccgggtcatgttactggtaggcttccttatggacagtaaatgagtgagacctaaaaggctcccagccttttaggagaagcaagcagagcttcagggaataagaatgtgcttttctgcaagacccatttccacccctgaatgctccatgccctgaatgtggaccatacactcagaggaattgtagctgcagtcaagagcattggcctggtttaataccttaatatgtgtgtggaggccttcctaaaagagcacatgtgattgagctgccttcactctatcaatcaagtggagagttcatgcatggcctttaacacaaggtatcacagaggaagcccatatttattcttaacaccatcatcatgactaacactgtggaacagtggctaagagtgtggactctggagacacattacagaggctttgaatcccaaatctactacttactagctgtatattcttgggtatgttatttaacatttctctgactctatttatttatttgtaaaatagaggtaattatagcacctgctttatcacgttgctctgaggatctaatataagtaatgtttgtacctggcacatagtacatactccataaatattatatagtatcatcatgatcatcatcactatcaatcatcatctctgccccaggatttggaggtgaagaggaatcactagatgggaatatgctgagctccagcagccaccattgatgctgagcaaaaccctcaccaatcaaaccccatactcagactatgacacaatggtttcaaccacttcccttatctcctgtgcctttgtcaccatcctgcagcaggtcctcattacatcttacctgtgctaccacaaaatcttccagacggatcttcccaaatccatctcttccttctctaatcagtcatcaacactgctagcagatcaatctttctcctgagggtcagagtttctatctcacacctcttcccaagcgctgctaccccttatactagatcacgctctatggagatgctgaatgaatgttttctggaattgctgtgtgagttcctttcatagggtaggaaatcatgccagcaataccaaaaaaagagggtcactagcaatagaagtgacatattaataatgttaaattccactgacactgtgttttactgtttacaaagcactctcacacattctaggtggtaggcaaggcaggttgcatcctcattttaaagggaaggaaactaaattgattacagaggtaacatgactcaaccaaggttaagacaccaccaaaattgtgtctcaaagtctcttggctggtttcacattacctcctttcagtaactattcagaaagtagggtcatgttatatttcctgaagaattgtgctcagtatgtttagaatgataaaataacatgtattgggtacttactaaggtcaggaaccataccaagcattctacatggattatataatttgactctctcaagaaccatatttgcccatttatcagatgaaaaaacatgagtttgcacatactaaattaccagcttaggataacttagcaatagcaaggtgaatagacaatgacaaccagagggctgtgctctgaactgggccctcttctccttcctgcctctgggttcctggctgagtctcaagtcaatttaacctagatgatgatttgggctttttctatatcacttatctatatcagttatgtcttacaggagaattatgtaacaatttagaaatgcatatgtattgtgtattatagtttaaaatttatgagcttaatcaaatttttattttcatctgagatttttttatctgagacttatttaactaaaaataaacatgaaatataatttcactctaaaaacatttgtaatgggtctttttttaaatttgcaaactttttataaatcttgtgatacataattctttcttattttgggtttcatattatagttctaggacattcttgcctaagccatagttttttatgcttagttcaaaagctgtcaaaagagtattctcctaatacttttatcaactgcatttcttctttgatttgcctagttttccatttcagtatatttctatacatcgataatattaacccagtttcttatttgtggcacctttcaaaaagagtttcttgcttaacattgaattttgtaactcatgtgtttgtatctacaaaatatttaatgtttatggacttaaaccaattaatatttttctccgtgcttttcaccattgcttttttgcctagaaagtcctttcctatccttcgaagagataatctgcctgcactacctttaattatttctaagttctctatatttaatcttctttctccttctttcctctggtttatttctctccccctcttctctcctaatctctccatccatccatctatccatccatccatccatccatccatccatccatccatccatccagtctttctctctccttatctgtctttctcttactctctattttgtcattaagctctttcatctgcttttgacataaatcataatataaggatcaaaacttatatgttaccaaatagttaaccaatagtatgcattattccttgaataacttctataccaatccccctcgctgatttcctttatctcctttatcgtataccaaatttttgtatatttttggatttgtttctgcatcatcattaggggtcattgttcttatacaagcacaactctgttttaactatactcttaataaatcccatttgattatattatttttaatgcatagctgtatatgatttgctagggttttagttacgtattttgttttgtgtttataagtgaaattatgtatagctcaatatctttgcatcaaaagagaacacctttatcaagttgcatcattgttgacaaaaagaaaaaccaaatagcaaaactgttctatcttttatgatagttcaaagacatggaaattataggatccttaaaaattgtaatgtttgttcataaaatattgttctcccatttcttcatggtttttaccaagttggatttgcaacttcttctaatatcattttgataactcataccatctctaaaaagggttgataagtacatttttatatgcatctttggtcctagttttgtgaggaatatttgtgttttgccaaattcgtttttcattgaaaatgtgatttgtccatcaggctatttaatagatgagttttctcccaaaggaccagatttttaaaccattaataagttctacggttttgtattccttcacatattaatttcttcttttatttttataattgttatgtaggcttattttttctaatttcttaatttaatgtttatacattcattttcattttattaatcatgataacattaaaaatatatctatgaaagtcacaaagtcagaaagtattttgtcactttgggcataattcaaactgagatctgacattttccattactttattctgcctataatcatgtactcaacagtgattgagtctctaacacaggcatttgttctacaaatgtgtcctgaggatttactgtgtgccaagcacagtgctatgttctaaggttccagattagaatgcaatacagaacctgcttttagcaagttcaccatctagtggaagtgactgacctgtaagccagcgattttgttgcaatacctaagtactacaatgaaacaaagaacaaagcatcataggaggacagagaaaagagtgacaaggacttactctccttgttactccttgttgaatgggagaggcaataaggaaagcttcaccaaagagaaacctttaaccaagtcacggtatataaacttttcttggttttttttgttttgtttttttgtttgtttgtgtgttttgagatggagtttcactcttgttgcccaggctggagtgcaatggcacgatctcagctcaacacaacctctgcctcccaggttcaagcgattctactgcctcagcctcccgagtagctgggattacaggcatgcgccaccatgcctggctaattttgtatttttaatagtgacggggtttctccctgttggtcaggctggtctcgaactcccgacctcagtataaacttttgtttaggtgaacaagaagaaaaccccattttagggggcaagaaagagcatctgtaaatgctaagagtgtaaaaagggtgttgatgtgaggacactgcaagtatgtagctggagcattgtggctgttaaggcaatggaaggaggcgaatctcaggtctataactggaagcaaagaggtccacaagaaggttgttgcaggccctcattaaagcaattttcatgggcaggtttttgagctctcatttggtaaataaaagcatcatccactgtttccctttttgccttgaatgtcaagaaagtcaaagtcatatttaatcctcaaccacagaaattgtattagccctttgaatcagtatatttttattcacctccatttcatagagtgttcattttccattgcagctataacaagttaccacctatttagcagctaaatacgacataaatttattcccttgcagtttccatgtgtcaaaagtcaaacacaagtctcaatgggctaaaattgaggtgtctgcagaactgtgttccttactggaggctttagggaataacctgcttccaagttcattcaggttgtttgcagcattcaattccatgcttttgtagaagtgaggtcccagtggccgggcgctgtggctcacgcctgtaatcccagcactttgggaggccgaggtcggcggatcacaaggtcaggatatcgagaccatcctggctaacacggtgaaaccccgtctctactaaaaatattaaaaaaaaattagccgggcgtggttgcgagcgtctctagtcccagctactcgggagactgaggcaggagaatggcgtgaacccggaaggcggagcttgcagtgagccgagatcgcgccacggcactccagcctgggcgacagagcgagactccgtctcaaaaaaaaaaaaaaaaaaaaaaaaaaaaaaaaagtgaggtcccagtttctttgctagctgtcagtaagcggtccttctcacttccaaaatctacctgcattccttgacttatgttccccttcctccatcttcaaagccatcaacagtggtttaggtccttctcaagctttgagtatctctgacctcttctgctttttttctcattctgccatatctctctgttggactcttctactttcctcttctgtttccagggatcacatgattacattcagcccacctgaaaaatcctgaatatattccctatttcaggtcagctgatcagaaaccttaattccatcttcaaagtcctgtcacaacaatacctaaattaatatttaatcaaatagccaagtgatgggacacttagagggacatcattagaagtttacctgccaaatatgatttaaaaaatttttctatttcccttttaatagttttattgacatgacttcatataaggcactgtaagtccgtataggacttgtattcttcttctttactatgtttactgtttgggacataaaagtaaaatattctcaatgtagaaaatttggaaaataaaaaatgtataaaacattataaccaattataatttcatcacttgtacatagccactattattagtatttatatcttttcttttagtcattcttttttgcacatttttataaaagtgaaagttcaaagtgtatgcagtattctattgcacctcttaaatcactgtcaagttgagagccatttctggcatttagtgtttacataatggccacataacgttatggtgaatgaatatattttactctattttaggtgtatatgggatattaccagtttttcattatgaataacattgtgttacccatttttaaacataaatctttgctggcattttagatttctttccggatatatacttacttaggtgtagaattgagtattatgtttatctgaaagtattccttacattctaaaataggcttgaaaatgggcttttaaaatatgaactcagagtaagcagccgactatgactacatgtgacattgcaaatattaaaaaatatttctgtaaagtctcttctcatattacagcagcaatttctgaatatatttgtggcctactgtaataaacctcaatttacacaaattgcaaaaggtgtggtagtattgattgctgtacaccaaatatcttctattctctttacaggcatatcttacgatcgcacttctccattcccttggaatttgatgggtcatacaacttgtttgcataagtggacatatgtgtgtaacttatgagtgaggattaagagcagtatatgactagccatacatctctttctctcagccataaagaccgacaatgttccagactgcagctactctactagcttaggttctgcaggtaggagaaggcagagaagcctccccatgacagacacaatgtgagtaaggaacaaacctttcttctttaagccagcaagatttgaggattatttgtattcatccatcttgagtagactgaataagggctcctaactaatagaaattagtacacagaagtgggcttctaccataacaaaaatgtggcattcattaaaagccgtggtgagaaaattgtccatggagctggaagaatgttgatgcatgttgtacagtggcagactgtttggaaagattgtcatatgcaataacttggagtgaatatcaaatacctaacaaattgggagaactggtggagtaagttggaaaaaaatgttactaacatgtattggctactggctctatctgacaaggtactgtagtagagataagatgaagaaagaactagctggcttgcaaactagattaaacagaaaatagaaagttcacaaattcagggactggtaaatttttagaagaaatgactacttcttatacttaaacagtaaaatacagagaaatatttttgagtagtaaagtctgattaaaattcagccttgcagctaatattaaattaaggattatcagtttcctatagctattgtaagaaattactaaaaacctgttggcgtaagacaatgcaaatttactcatagctctgatgggcataagtcttaaatgggcctctctgggctaaaatcaagatgttgacagagatgtgttcttttctggaggctgtaagggagaatccattttcttgccttttcgagtcctacaggctgcccaatattcactggctagtggcccctttccaccttcaaagccagacgtaactggttgaatcattctcctattgtatccccctgacgctgattctctttctatctcctgcttctgcttttaagaacccttgtggttacgttgagcccacctggataattcaggataccctccctattttaaggtcagcaattccatctgcaaccttaattcttcttgaccacataatataacatattcgcaggtctggggattagatggtagacattttgcggggactgttattctgcctgccacagagtgatacctagaatatcttttaaactgggcaaaattgttttgggaaaagacattagaagtgtggttctggacacctgataggcacaagatacccacaatgcaatcaagagagtaagggaaagggacagaagcatgggagtgaggaaggaaagacgcttagcaaatatgactgttatatctaaaaagaaactgtcacgagttttggtacatgaagctgactgaaatcaaagagaaaaattcagggaagtttttgagagaattatattgccaaaagaatcagcttgaactaaaagagaatgtgacagttcaggacttaaaataacactgaggcttcaaccatcattggataggatgtaggctaaggaggctgcctgttccctaagggaggtatattccctgacacccacttcaaatgtagtcaaagaggatcatggaaaggaagactctcccagaggacagagacaaggaccatagattctaggagctaaggagacccttctactccagggccatctcaggagaagagtccttgaagcatttgcccagtaagacctgagagttgcaatgacccattgcagtgattgtagtacaccttcaatttgtacactttctaaacaagagtatttactgagatgatcttggcctgatttcgccactgcatattggctaggtagatgggtgggtagggaggttagtaacttgccttttttagttacaggtctctgggtcatcaggggccatagctggatctgatgcaaatatttcacatcatccctagatattagcttaccaaggatcctggactgtgtgcttgatgctatgattggaaggtgtttgagattgtctccttcgaggaaacaggagagggagtgtgtcttacctagagaaagcagagaggaacaaatagttggtagccacaagggcacattgtaatcagcattggtgctactcactaatatctgttcttttttccttctacccatgtaaaaaaactgaacttcttagccctttctttgttgtgtcggggaatagtagttctgaccattggaccatcatttccagaacacttaattcttaatggtgtaagatgctccttaattactgaattctaattcttaattaagtacttaatttctaattaacgcttaattctaattcttaatggtgcagaatattcctgagttctcccttctccctgttgaggtgatccgagaagcatgtgtaaagatggagcttccatcaactttctggagcttccctaccaacccactctgggcatatagtatgaggtataagtacacttttgttacaactagggagttattcattactgtagcataaatcaacttaccctaactgatacagaacacaatgacctttcatttattactttgtaaaacttttattctgaggtttaagtgtaagatcctgtaagaggttttaataggaattcatgtacatgccttctaattatacaaaacactttcaggaatacacttattgcagaaagtaagctatagctgcttgttaccttcttcatgtatataaatttcaataaatttaaataaatatttaaagatgagaaagaggtgaatttgtaagaaagtcagatttattatacctggggcaactccacctttcattgcatccatcagtcaaggatttataacatggattattggctctatttaattgttaaacagaagttgaagccttggatctgtcaactaagcagtttttgaaggttgggattgaaaggacacatggaaacccaccccatcaagcaaccctagggttgggtcacaaggggtaagacttatttgcgttatgtacatagagaaccaaagggtaagtgtcaaagtaccaaaagtcacagaaacaatatttattaaccaagccaacatgataagaacaaagtcaaaagatacaaaaaagttataaaatttaggtaaatgcacaacttcagctaaaaaaaaaatgtcaagcaagtgtagcaacaagatgaaaaggtacagaattttactacaaacacacctgagacaactgtaccgctctatcattggatgctatgctgatccagaagttaaacacacaggctgctgcaggttaaatacacaggtttcagacagatagtattcaggcttgggatgtcatcgaaataactaggccatgtttctgatataactgataaatttctacagtgattgttttaggttcctttttttttttttttttttgagacagggtctcactctgccacccaggctgcagtgctgtggtgtgatcacagtgctcactgcagcttcaacctcttgagcttaagtgatcctcccaactcagcctcacaagtaactgggaccacaggtgcgccaccacacccagcatttttttttttttcctgtagagccaaggtctcactctacctttcattgcatctatcagccaaggatttatatgttgcccaagctagtctggaactcttgggctcaagcgattctcctacctaggtctcccaaagttgtggaattttaggcatgagccaccatgcccagttgtctcagattcttaatatcatgacaacctctatgacttcataagaacatactggttttcatttaaatagaaaagttgatcacagaaaaaattgaaaggagagttaaaggattactataaagaagaaaatagggggaggaggcagaggagaaagaggagcagaaaagggagacgtaagaagagatgggaaagtaaatgagtggttaacaaaataaataaataaaaagataagtttcgctgactttggaaagtctgaggaccaaaataggaatgctactgagggagccaggggaaaggacccaaataaaagctgaagcaaccggaaatgtaaaaaagaatgcagatttattggtgatgcaggcagttagacctggcctgagaataaaatcactgtagatagttacactggagtatccagagccgagagagagctcagtaggaaacatctgatggctgtgccagtgctcagcttaactttggctcctattttttcatagctgagagaatctctgggtgcccctgggcaaccaggcaccccttcctacagatggaaaaaggtttattacatttcagaccaaaagcaaccaaagtgttctgcagaaaatgaaaaagaaaatgcttaatcatttctaaaggtgccaaatcaatttctccttgagaaagtgcaaaccagtgtaaaatttttaaaataaaaacaatttatctcgtgtttttttccaggtaaaaatgtaaaataacgccttgctttctgatcaacagtttgcctcatcaccaaagagtacagcaatcttagaaatgtacctgaggatttattccaaagctggtataaaacatttcattccaaacctatatcatttgaacaaaaattcattagggtttataaattgaagagatgcaaacacaaagttggcattcctttaacattttcaaagataataaaagtatatagtgactgctttcacccaagtaagcctgtcaaaatgttggcaatattgctttcggctgttttctggcagcatatctcatttgaaatattttcctgagttaattttttctatttaataaaaggctaaacatgaagacatgttcttgggtctataaagaatgcattaaacctctcctgatgacttaaaatatcttcaaaacagtggccatggtttgtcataattgcattctcacttgtctatgttcatttttacttcatttggtttgtagagtgaaatgagaactggattcaaaggtgtgccaatgatgttgtctgggaactagattcatctccataagcctcactccttcatctgcaaaagaggtataacaataccaattacacccccttcactgggttgtttagggaaaaatgactactgcaaactaaagtcctttgaacagagaaaagcataatggagatttaagacatgtactattagtggtgttactatgatttctcttttctaatatagtttatgtcaacagggctccaatgcaagggtttgtgaaagatctactgcatattcaagcaggtttttgtgcagctggaaagcctatgaagcagacaccacaggaggccttacagcagtccagagaactaagacctataagacactaagaaactcaattacccccaaccattgaggcaagagagtggtgatgagcaagcaattaggtggcaatcattagaggtaaactagggaaagttgatctaatcctttctcagtgctcctcagacttcagtgtgctacacatcacctgagaatctcatgaaaatacaaattctgattcagtaggtctggggcagagcctgagagtttgcatttctaataagtagtatagaaataatatagtatctaataatcagacaatatgtacactaatgacccatgacctatatttcaaatgacaaagatctatttcagaccagcctcaaaggaaatctgtgtcagggctctaaggatgaaattggaaacctaaaatgactacattcatcttaagaacctgggagcacaattcagggctgcatttctctaacatgtcagagttggtagggcagttcccacgatggcacacaggcacaggggattctggagaagaaagggctcacattgcaaattctgaggtgggtgatgtcaagacagatgaccacaagtaaccactgcttgggttggcaggggaaaggatggcttccactcagtggttgaagcagggggttgtcatggacaatcaagagcaaatgagaattcccagtgataccctgaggaccaccatgaagaggcttaggctgaggctgcagagatactgcaaaagggcattgaatcagaaggtttgttgctgttatcataagcctggtgtacccaagctggtgccatttggagaaatgccggttatgtcattatctacattttattatacaatcatcattagtatcagcatcctcagtataacaggatgatatccctgatatgaccactggaaacaaagccactcaactctcttgggcagtgatgctcctttggtgtttccttcatatagataaacccagagagtctaatggaacacaatttttttttatacaacaatcttgcatacatagaaaaactaatatctggcaagtagaattttcagaggaattaatctaatttaagagatattaacattctcatatcaataaatagttaagagaaaggtaatttgcaaagaattcaaatgaccaaaaaaacaaaatattaagctatgagaagtcatcggcattggcgtttttccagagcttcccatgtgcttcagcttcccaaatggtatctgctgtcctaaagaactatgatctcttctctgttccctcataaaccatacactacatccaagtggttttctaccaaggtgtctcatgttgctaaatcagtataaaatataggacatagagctatagtctgtgcacagaatattatgtataaatttccagctaccatatttatatagatactccagcatgagagtaaatgttactgataagtctgtcctacacatgagcattatttattttgtttgttattgacttgtctctacctcacactgtgctagtcactagagttgcaatcatggacaataagaaatatgcctgtcattatgaggattacaatacagtggggcaggggacataaataatagtaaaacattagttgctgtgatgggggaaaaaaaaaaaaaaacaaggagctaagctagcagcagggaggacctacttcagatagagtgatcagagaagtccactctgaggttatagtggtgctggaagacaagcctagtgaaggagaacaaggagagtttttctagaaaagagaagctgtttgtaaaagcctgaggcaggaaagaaattggcatgttcaaaaaatcagcaagaagccaacctgtttagagctaccaaaaagtataagccaagttcttcgcagttgaggataaattggtttgtttctcaacttaatgaacactaattcatcacctatacatcaaatactctatttgaacaagacaactctctgtgaagcttatgttcaaatgagggagatacactctcctgatgtgttatcatagaagcactggaagccattggaatacataggtagttgggggcaggggtgctttttagaatatttttttaaacatcattattttcataatataaaattttcttttttcaacttttaagttcagttttaacttttattttaagaaatatgtgctggtttcttatataggtatactcgtgttatgggggtttgttgtacagattattttatcacccacgtattaaggctagtaccccttagtcattttttcctgatcctctccatcctctcaccctccagtaggccccagtgtctgtagttctcctttgtgtatccatgtgttctcatctttttgctctgacttataagtgagaacatgaagtatttggttttctgttcctgctaaggatagtggcctccagctccatccacgttcctgcagaagacataatccctcattttttggggtggctgtatagtattccattttcttgtaggaaacaatcagttacattaacttaaaaaatatttacattgaaatattagatatttcaaattattcaaaaagttgaaatacatgttccttacttccaatatttctattccaactggcaatatgtatgaaaagttcaaggaaaggcaagttgtattgactgattcttgaatttttgctcagcatgagacctaggaatgtcagccattctttctggatttctcttttcaggactaacccattcattgagcaggttactacactttatgtggaaatatcctgtctgcatcaacagattataaatttcttgagggcgaagatttggtattcttaccttcaaatgactcaaaacaatattttggataaattagaatccatataaattggttcattcagattcataaagtatttcaaaatatctccagggtccttatatatcccaatgtgtgattaatttgaaataactttcactacttccttttcaagtgagggttttggatcctggctgtcttttagaaagaatgtgacctccttaccagacactttcccctcattctttgtagaaacgaaaactaaacagggaagcttcctctgtcaggaaatctgatgctaaatcactctttcttccatcaccaatgaactcaatcatctcatgccaatacaattaaattaaggctcttcagcaccacttggcacatagattatatgattcctgttaaaaaacaaatccaaacatagagaatcttttggagaaaatctattttgagaaggtatttttattgttaataattttatcaaaaaaatttacctttgtagctgaagttttttaaggaatctgagccccgggataatttttgttttcctctgaactttggccagagtaacttatacgtacatgaaggcaggaatttttcctaatattactaagaagcatgaacactcggtttggacattgactggcctgaatatgataaataatatatttcctctttcaaacttctacatgtaccaaatattataactttttgctcaaacaattgcatcttaaaatttccatgtagtcacagccaaactccttagaaggttaaaatgtattacatagtagaatcaatttactttttaaaaggaagaactgcacataccaactggtaatggtaatattaactaattgcttttataggacaccagactaagtgaacgaccttaggcagatatttaagcattttgccactacccatttaaattttgccatgatcgatttaggtcgtccacttcaaaattccaagtactatttctcaagataatgtatataaaatatttacagcttggcttttagagacttctacagttttctgtcaataccataatcaccatagaaactatgagtgtgggaaattaaagggctgtgtggtggccatcctttgagtttgcaaagcctgctcttgtgcttggggcaagcaagcctaatttgtcaactgaggcaacatggttgcagtctcaggtcagtgatcgtgctccaattggagcagcaatcactctgaaactatcctagctcagcaactagctcacattccaaaaagaactgcagtattagcacctgagctccagccctggagttatcagcaaaaacgctgtggctcccccgtcattctttccataaatattcattgggcatctactatgtgtcatcagggactgtaccaagtatggtagaatacatagattaaaactgatgatcccatctcttaagaagcatgcattcttggatgggcgtagtggctcaagcctgaaatccaagcactttgggagggcaaggtcggcggatcacgaggtcaggagttggagaccagcctggccaacatggtgaaaccccgtctctactaaaaatacagaaataagcctggcgtggtggcgtgtgcctgtgatcccagctactcaggaggctgaggaaggagaattgctagaagccaggaggcggaagttgcagtgagccgagattgggccattgcactccagcctgggtgacagagtgagacctctgtctcaaaaaacaaacaaacaaacaaacaaaaacaaacaaaaaaacaaaaacaaaccaaaaaaagccagccaaccaacccaccaaccaaaaaaaggcctattaatttgttttattaattcaagaaatatttattaaacacctgttatttaccagacatgattatagaccctgaaaatacagcagtgaataagactgtcaaagcccctatatcatggagtttacttgttaatcaagagttagacacagacagtaaacacataaatgaacaagataattttggatatatacaagtatcatgaggagtataagaaagtgtgatgtgttggcaaatgtggatggagttaccacttcagacaggatgagaagacatctctaaataggtgataactgagctgacacccaatgacaaataaaggaggagacaagcaatctaaaatcctagggaaacacattctaaagagcaaagaaatttgggtgtgtttgaggaaacagaaaggagagtgttgttagaccaaaggagtgaccaagaaagtataaaaaggtaatgacagagactggtcagaggccatgcagtgtatttcttatgggttatggcaaagtgttcagatcatatccaaagagtaagccactggagggctggaactagagtgccagtgaagggtcatactttttgaagaaaactactgaatagtgtgcaggtgctatttattattgaggtaggcaaatggtgggatgaaggatagtgataaggaataaaggaaggatgagagagagaaataggaacattttcacaaaggaattactcaaactcatgcttgaagaagttaaaccttcccgggtggacaaaagagggcagaatgaaagaagacagcatgtcaagtgggggaaacagcatacacagtggaatgaatgtgtaaaataacatggcatgttctgggaaccaacagtcggagttaagaatcaatggtggcttgatgaggtttgcatgtcaggcagagtttagattgcaggtgaggggggacccctgattatagggttttcatgatgcccctctttcttgccttgtctgcttgtcccctaatttcctgagatagctataggtagtttgaaaatatatgtatttcaatacctcatgctaatcccctatatactttatctgttatataaatcttcagattagcaccacttttgcaccagattggaaccagctgcttctgtatttattttcaccattagaatgtaagttccttgaagttagaaacaatgacatttaaattctgcaccctaatatctgacacagcattagacacataatatgaactcagcaaatattaaattttaataggaatcagatagataaatagatggttgaaatttcataaaatatttgaattagtctccagggctgaaatcagaatgttagcactagagcattttctataccatggaatatatactattaagatgaggtaggtagtagttgtttctctgatattatagtaagagtttctgatggcttttaagttcacaggctcaggattaatagctcacccccatccagtcttgtgatactgcctacatgtaaagcttcctcactagtctgaccagtctcaatgttggtttcctctagcctgatcatcagctccctctagaggaaagcctggaattagtacttagcctcactcatcttcctttagcctatttccatcgatttacagagcctgaacccagccaactgtggcaaccacctaatgactgatttgattccatgtgcaatctttcgggagtgccaaattctcaatctctaacacataagtatgttacacacatattactatccatctctctgagtgtcctccttctaaatgatgcagttatcatgtaaaggctgcagattacccagatatgagaaagagaaagagtaagaagcagacacagacaaggacggaggaaaagagtgaggattagatggatagaaggaagaacaacggaaaaattttttcaaaagtttccttgttcagaagatatatttatgttcttatttggaaaacaatgcatgtgactcagtattacataatccgtatgtggcaaagttcccagatcaagggcctgaagaatatatctatagcaaattttggccacacctggatgcaccagaagggcagcaaagatgacacaatgaacctcagagaagacacaatatttgaagaggtggacaactgtccctgaggttcagactccaaatgagtaaacagtaatagctatcctttgtctcaggatggaactggatggaggagttccacatagggaaagaaacacagtctgaggggaaagacaggttgcacccatttgtggaatattagttgaaggttgaaaggaagaagagattttgtgtgccaccctgaacagtatttaatgatctttctgcccagctcccagggacatatgatgggttctcaaggaattaaaaagggaatgagatggaaaaactatacatatgtgaaatttagaaatatgagaggtcaaagcaattctggttttagcttcatagcctggcttaacatagaagaaagatatgactgcttcatcaggtaaaaaggacgcaagattaagagaagcattcaggaggtggtcaacaaacattgatttcctccccctgttcccttccacattgccgtctggaggctagagtcaacacacacacacacacacgcacacacacacactctcatcctgacattagcaagtattgcacatttgacgtcatggatgcaaacctcccagtggtgacctctttttaattcctctcccgagtaaagtttctattgatcaactaaatgtatgaatgaaggagtgaataactgaacaatttagtgaaattctatttagtattcagatctatacttgatactgcaagacacctcctgatattatttaatccttattgcaacaatgtataaattgttatactcatttagaaattagagaactgaagcttatgcaagtgacctgcttaggatcacaacatagaaactaagatttgagatttaaacacagataattttaatttaaattcatttccttttctaacaaagcttcaacctataggtgatttcacatagtcacagtatcaatcttagtcattaaaatacacatttcgttgcaagaagtgtcaggcactgttgaatagctagcctaagactcattttcaaacacctaaatactcactgtttcagattctcttgaagctagggaaggccagccgtcttgagttctggtcaatgatttgtaagtggaagtttgttgatggatatggaaaactctgctttttgaaagaaggaacatacatctctaacattccacctcccctctacatcctgcctgactatgaaaatgatgcttagagcagcaacaatcatcttgtgaccattaggaaaaagtaaaaaaaaagaaaaaaagctgcagagatgctgcttcttacctcattgaataactacctatatccagactccttgctgcatgagaaaaacaaacttctatttgtctaaggaattttaaggtattctgttaattacaggtaaaacagcaactaatacagaaaaatgtctaaaacaccatctctaaagtacacatattagtgagattttaaaaattaaattgtattataatgaatatatatccttactttaaaaagcgtatttccaaagtcataattttctgctctaaaaaaagatcaaatgtcatccatatttagttgattctaaactcatgaatatgaatgacaaaagaaaatctttacaaaatttgaattattaagataaatacagttactgcaatttttctaaacggcatctagcacatggctgatgctcaataaaggctgagtgttaaaaactatgtatcttattagcaacacatctcagtactatcatttggaaaaagtcctttctctcacaaatcaatatcacaaagaatcaggcagcaggtggaggatgtaaaaatgaatcatttttcaataacttctttcagcgtggaaggtttcacatgtctagacatattttgctgttgaattccacactgatatttaagggattgtttttccccattgcatacaaaattactctaaatatagtaaagcattttgctcacatgctgtcaaccccaggcaaaacgtagagtccatctgtgtccttccctatagttccagccagtatatcccgcatcacacatcagtcatcaggtacaggttgagcaagaagacgtttctctccagtttgatgatgaacagagtgagttcttttatttttagaattgactagaaacattacagttttcccacatggcattcattaaaagtttaacctatcacttagtaataaaaatgtgaagaataacaagtaacaaaactttgactcaaaaaattaattttttttgtgagacaagaatgtgaagggatttggtgtttttgtgatgtttataccattctcagataatcagctgtcaatgtcttgcagacttataccatgtcttatttgagtaattttcagaaaaataagcccagtgggataagaaagcccaaatgcatactcatatcagggatgcacctgcatctgaaaggagaaaaggaaacaaattaaaaagaggactagaagatttacttggcctgaatgatgagagtcacctgggtagaaccaataataattgttcacatcaaatgatttctgaaaatgattttaaggatgttttacatagctaatgagttgttccccagtatacaagttcaccattctgatatatgtggaaagataatcttcattaacaaaatggaaaaattaaattttaaagtttctaacaggtcacaacattgctattgaatataccgacttccagcaccactgcacttgttctccattacatttcacttaacgtactcttgatccattacttgcagttatttcagataaggatggaactctattgtgggttgtttgtaggtgaaaaggcagtcttcactttcccatgatgcctaaaaagaataggcaattggatgcattgacttgtccaagtatgatgagagtctctgctcccccgtaaccaaattattgctaaccctcttttcagacaatgtatttccaaaaattccgttggccaacagtatagctgtttcatctgtgcagccccacttacatgcaggctagtccatagtggctttcctggagaaaacgatacttttatgtaataatggaaagggttctggatatgtcatacgtcgtgggtttaaatcctagctctgcaatttaccagatgtgtgaatacagggaacgtgcaaagcttccttgaaccttagtcccctatttacaaaactggggacatgatacttatctcacaggactgttaaatgttgaatgaaatggtttgtttgaaagtgcctggcttatagtaggtccaaaataaatcttcactaaacctgaactgtttagctttccagtaatacgaaaaaaatatatatcaggaacccagtaacttcctagtgtccagaggcttaaatgtaccacacatagaatacagattgtttatgtttatatgtgcattgttataagaaaacaaatgccacatacccacctaacaggatgaaatgattgacaggtaacattgaccttcttccaggaaatcacagattttcaaaacaagcactttttaaaattacaaaaatatgcagcatgaatcagaaaagcaggaggctgtgtttgtttgatcaacatttcattttccatagcttccatcttcgttttattgcatggtgtgctatttccctcaatagaaaaggaaggctactgggatgtttgttataatcgtctgcttaaggttctttggcagatcacatgttttacttaattaaataatgtcccaattaattgatttgtttgtagacattcttaatttagtaaaggctgagcagaatgctaaaaataccattatatttctgacagaggcaccactaaagtctgataattgatagctttgctgttttctctgatggcctgaaaggcttttaaagctaaattctgtaatcatgttcatctttggaaattagttttgtgaaaccacacatttagttcttgctgagaaatctcattttagtcattttaacataatttataatgcataaactaaattagcttttgtagctaagccagcacatttttctttaatttttatctcatcctaatatatttttgaccttgaaaactgtaatgtctgttggatattgaagcctctgaacaaagaaaatcatttccattccatcactatggttacactttcttcgctctccagcactgaacactgctgaaagtgttgaatctggattcctcaggagggcaaggggaacttcatgtaatatcatttagttctgattaaataaacacatatacataatggaacccaggaaagtagcaaattacttcactttgtttacattgcatatgatctgactgatggtaaggggcaatatatcacccaatgttatacatttcaggttctgctgtgtgtggtttatccctaggcagtcacacatacatattcgtctccaaaaacacagtcaaaatgccaggcagctcctaacacctccaatactcctgaagtcaaagcggttttatccccttctaacaacagagaacttctagtgcaaatcatacagttccctgtctgccagagatgtgtttcaaatgagcttgcaacgtgtctctctccatcctaaaatgggttgtggctgcctataaaagcaagagaagaacctggtcattcaaacgaatgctatacctgctgcctctgatagaaaaatacccttttttacagacggcagcatttgttaaaacgtgtcttgaatttcttttattacacagctggtctacaatgttaactacaataggtttgctgttttgttctttgccttagtagcttatgtatcaaagccatctccaagaaaatcgttggtaactagttggtatcattaagggtcaatactgtttttaaaagtacaatgtatccaatcagtattatggcatattaaatccatataaactcaaatggaatgtctccttcccatggtcgatattcacagatttccagctacatgggttggcttgtgcaaaagtaatgcagagctattcatttcagcagcatatgataaaaaactggagtgagagaggaaacagctagagcccaggtaggaaagaaatctgcgtcttgaatagctttcaggtacatggaccacaataatcatctctgtggcctggcacagaaaatacacaataaatatttgtggcatggaagaataggtgggtatttgaaagggctcacttttttttcagatgtaaagatcttttggtggtggaaaagaacacactgatactcagacagataaaaggcagaactccagctccaagtaaaaaagggctgccagccagggtcacacagggggtggcatccaggaagagggtagcagcaagctggagctggagggagcagcctgtgtatggcaaatgggattgagctagctaggtgtcctggactcgctgcagattagctaatttgaataattctgtgggctccaaggcatgagggctagttgtccacccctgggtaatagtggtcccagagtgaaagagcctgataagagaagtgatcggagtatagacttaatcagcaactgaaaacgggaaattgatccacatctagccagggcctcagaactggatcaatacagcatttttttttttttttagacggagtattgctctgtcgcccaggctggagtacagtggcacgatttcagttcactgcaagctccacctcccgggttcacacccattctcctgcctcagcctcccgagtagctgggactacaggcacccgccaccatgcccggctgattttttgtatttttagtagagacggggtttcaccttgttacccaggatggtctcaatctcctgacctcgtgatccacccgcctcggcctcccagagtgctgggattacaggcgtgagtcaccgcgcctggccaagacagcattttttaaaactctgttacattcatctacctacagaaataaagaatgtggttaaaatgcagcaaagcattacatgacattcagtagcaaccaaaatgtcattgaagtgtgacatggagtatgtaacaaaagctaacctggctgctatcgtttggatatggtttatccctaccaaaacgcatgttgaaatttgattccttatgtggaggttttgggaggtgggacctagtggggtgtttgggttccgggagcggaacactcatgaataggttaatgccctcctgtgagtgaataaattagttcttaccagagtgggttgttaaaaagagtctgaattcctgggtttctctctctcttgcttcctccatttccatgtgatcgttttgcacatacctgctttccttcggctttcagccatgagtggaaacagcatgaggccctcactggaaactaagcagatacaagcaccaggcttcttgaacttcctggcctatagaaccatgagctaaataaacctcatttctttataaataacccagcctcaggtattctgttacagcaacacaaaatgaactaaaacattggccctgacttgaactaacgatgcagataattataaaataatttattagaagtcttttgggggggataatcaagttttcataatttagttttgatatgtaaaacactaaagagaggcaactcccaaacattttctatatttttgttagcctccaatgttttccactatgtgccaggaacaattctgcatatgggttggagtctgtattttttaagcaaatgtaactgggactgcccaagtttagtaggcactaccatcatataattcatcatgctgcattggaggcagaaaccaaaggctagctgtggtaggcagaataatagtccctgaaagaggtcctcaaactaatcccttgatttgtgactacattatgttacatagtaaggagaattaaggtttcaaatggaattaagctggctaatcaactggtcttaaaatagggagattatctaggtagccccattataatcacaagggtcctcaaaagtagaaggagacagagaggaagtcagagtgatgagatgtaagaaggactagataaactattgctagctttgacgacggaggaagtataccatgagccaaggagtgtgggcagcctgtacatgacagaaaaggcaaaagaatgggttctcccctaatgctgtggcctgagaagttgggctgtattcctttcaagagaaaggaatacagcccaactgacacctcagttttagccccatgagacccatgttagacttctgacctttacaactgtaaatttgtggtgtcttaagctattatatttatggtaatttgttgcagcagcaaataggtaactaataaccatctaaactcccaaagcataaaaccactacttctatttttttcccatatttcctttacacaaaattttgtttactaagaagacaagctctcaatgacttttccagagacaactgacttttgcttttgctgaggtatttgaatgtttcatatacaacccatgacaacttcatactgaaagcattttctgtcaatggaccgtccttcattctcaaatattaattttttgaatacttgtatttaaaaataaatactaatctactttgattttgtagaaggcaaccctagaatataagaaaattgcttctcaggccacagtattgactttgaggacttcaatactactgccaaataatatttgaagaagataaccataccctctgttccttaaagtaatcattatttttactttctttacccatattcattcttgtacactcaaaaaacacagctccaactaatccctttagttagaagtagaggataccagaatttacgacgtcttttgaatgaaacacacagaacagaagtggtttcaaggtcaggtttaaggggtataaaggtacatgacagtagctagaaaacgcaaggtggctgagttgtcatagcacgaatccttcatgagcaggcattattctaatctggttatcaagtttatgggtaaatatcaagaggtgaataatctagagagcagttctctgaatggagagtgagaaaaaaactgaatgtcaatcctagcttctctcctgagtaacagagggtagttttcatgtagcctcccctctgtttttgtgtgaccttcctctgtttctacagctaaatcaaaatgcttctgtatcttgcagggacaccctcatccctttactttccagttgttgcccttaatggagttttgattctttgatctgtctcctctgcttttttcctttctgagttcagaaagcttgagtatctgattttcctcttttgctttcttatccctccaatctggtctttaaatgtcagttttagtcaagggtctttccatttttacactaagcctgtcttttttcctttttttcttgagaggaaagtttcttttcaaatccactttgttactgttgtttatttttgttattgttctctttagtaacaaaactttgtatctcacaggaagtagtgatgacatctctagaggcaaattttacttttttcagcatctattcactgaacaccaactttattccatggtaaacttcagggagaaaagaataaaagatgagtgagacaatctaccctaaaataattcaccaactagaaaattttttaaaataactatattatagaaaataaataaatgtgatgaccatttcctaaaggtcctgacatatggtactatgtgatggttttcttctcctttctcattatcatccctgagcactcaaaatagcggacctcagtccaaattcccccagctggagtacaaccaaacagaagtgtaaatgttcaggcacccatcccatcagtgacccacaaatccctgaactaaaaatacttcataagaaagaagagcaaggagtactgaaacatgataagtaatctcctctcaaaaccattctcagtactcactctcacaatgacaaagccccctttgaagatactcaaaactctgcccaggaaaaaaaaatgcaatgtatccattctcttaatgatggtcatttggattgtttccatttggggctattattaatagagctgctgcgaatatttgtataaaaaaatctctttttggggatatgttttcctttatcttgggtaaatatgtaggaatgaaattatttggttttaagttattcttatgctttaatttataagaaactagcagttttcaaattgtttataccattttgtactcttaccagctatatataaaaattctagttgctttacatcctggccaacatttagtgctgtcagactttttaaatttaagccattctagaagtggatatcttatttttatattaatttgtatttctctgatgactaataagattgtgcaacatttcaagtgcttatcggttatttctatatcttccttttgaagtgtctgatttgcctatttattattgagatgtctttttattattgaattgaaggtattccttatatactttgcatacaagtcctttgttatatatgtatgtatgatgaatattttcttttatgtttgcctatccattttcttaacagacactttcagtgagctgaaggttttaattttgaataacagattattgtgttttttcttttaaggtcattgttctccaagaacactgtaccagcctcaggattatgaagatattctcttaccagattattctagaaactacacacttttagcttttgtatcagattcatgacccatcttgaaattatttttaaatgatgagtgatacatagactgagttgttttgatttgttttgttttgtttttctcactgtgaataccagtgttccagcttcatttcttgaaaataatttattttctcccattgaatggcattggcttttttgtcaaaaatcgcttgactatatgtattagtccattctcacattgctataaggaactacctgagactgggtcgtttataaagaaaagaggtttaattgattcaatttcaacaggctgtacaggaggcatggctggggaggccttaggaaacttacaatcatggcagaaggcaaaggggaagcaagcacgtcatcactggccagcaggagatagagagagcaaaggggaagggctacacattttcaaacaaccagagctcatcagtactcactatcacaagaagagcaaaggggaaatccagtcacctgatccaatcacctcccaccaggtccctccccaaacattggggattagaattaaacatgagatttgggtggagacacagagccaaaccatatcactatatgtaagtattgatctacttctgggcactctattctgttcctttgatcataatagatctagcattaggtcaatatcaaactatcttgaatactgtaacttcacaatatattttgaaatcaggtagtgtatattctttgtcttttctcttcaagattattttgactattcctggtcctctgcattaacaaataatttcagaatctgcttgtcaaggagaaacagcctcttggaattttgagattacactgaaaatctggagacacatttggggaaaactgacattttaacataattaatcttgaatatggtatatttcttcacttatgaagatctttaattttatccagcaagatttttaaattttctgtgagtttttgcacatcttattttatttctaatttttaatgtctttaattttttttcaatatgattagcaaattatgtgcttctgttacatagaaaggcacttgatgtttgtatgtggaccctgtatttggtggtcttgctaaattaatgtgttggttgtagggttattttgtgtagatcccatagaatttctatgtacacattcatattgccatttttctgattgtgtggttgatttgccttatgctagccatgaccttcagcacaacattgaatagaagcagtaggaacaggcttccttgccgtgttcccaatatcatggggaaaaccagcagtacttcaacattaaatattttagctgtacatttcatcagactaaggaagctccctactatttctactttgctgagaggtttttaaaaataactattgaattttatctttttctgcatttttattttaactttttctgtggcatactactttgattttcgaataatgaaataatattgcattcatttgtaaaataaatcccactttgtcgtgatgtactatccaattatacatttttaaattcaattcctaatattttgtcaagatttctgcacctatgtttatgaaagatattagagtatgacatcaaggttatgttcgctttataaagtttagtagcatttccaactcctttttctgaacaagtttatgtaaagctagaaatatttgttttttaatgtaagacaaaattttccagataagcaacctagctctggaattacgggtatatatatatatatatatatatatatattatgtatatatataatatatacatgtatatattatatacttatatgtatattatatacaatgtgtatatatgtataattacatacatatatgtatattatatacatatatgtatatatattatataatatatgtatatattatatacacacatatataatatatacatatattatatatgtatatattttatatatacatgtatatattatacatatattatatataagtgtatatattatatatatatatataatatacatacgcgtatataatatatacatatataatatatacgcgtatatattatatatacatatatatgcatatatacacgtatagtaatacatacgtataatacacgtataatacgtgtattatatatatatatatatacacacacatatatatatatatatatatatatatattttttttttttttttttttttttttttgagatggagtctctgcactccagcctctgttgccgggctggagtgcagtggcacaatgtcggctcactgaaacctccacctcctgggttcaagtaattctcctgcctcagcctcctgagtaactgggactacaggcacccaccaccacactaatttttgtatttttagtggacacagggtttcaccatgttggccacggccaggatggtctcaatctcttgaccttgtgatccacctgccttagcctcccaaagcgctgggattacaggtgtaagacaccgtgcccagccaattatgggtatattttaaattacaaattaaatttctttaacagttataaattaagtttttaaatttgggagcataaagttactcacagtattttcttactaatttttgatgcctacagcactacagagtgattccaacatttcttttattggtaatttgtatttttattttcttttcaaattgttatctgtatagctagggcaactcttctcaaccggggttccatgaaagaattaagcctgaatgccctaagggtatctaccatgtaaaatgaaaaaaaaaaatcctattgatctaaactagtagtattagatatgtaactttcttggaatataaagcaaatacacaatccaatcatatttgttaagtctcaattatctttcaaaatcccagttgtgaaaagtcacttctcaattttattgatcttctcagataattgattttttggttcactgattttttttaatgtttgctcattttctgtttcattgattttcattatttattatttcttctcttcaatttactttgggtataatttactatttttttcttcttcttttccactatgttttttactaagatgcagcctcactatattccccaggctgaactcaaactcctgggctcaagtggtctgcctcccgagaaactgggattacaggtgcacaaaaccatacctggtttactcttctttttctctcttcctaaagtgcaaacctagatggttaatttaatatgattcttctttttgtaatataataatttaatattttaaatttccatctgaacaatgttgcatctgtatctcacaaactttgatactttatgtttttattatcatttagtaatgtattttgtgataatccctatcatttttttatttgttatatagattacttaaaattgtgttgcttaattccaaaatatttgagaattgagccaggcacattggcacgtgcctggagccccagctactctggaggctgaggcaggaggatggcttgagaccaggagttcaagagaattgtgcagatattttgacattagtttctaatctagttattttatggacagagaatacatactgagatattttgataattttaaatttacaacactttttaatggcccatcatatatacatagtctttttttcagatttattaaggtataatacaaataaaattgtttatatttaaggtgtacaatttgatgtgttcatatacgtgaacattgtgaaatgattactacaaacaagataattaatatatctatcactacacataattatcatttttttctttgtgcacatgtgtgtggtgagaacacttaagatctaccttcttagcaaatttcaaatatgcaatacaataaataatgttaactatggacagaatgctttatattagatatccaaaactcattcatcttgcataaccgaagctttataccttttagcccatatctccccatttccctctccctgcagcttctggaaaccaccattctactctctgcttctacaagtttgactattttgattccacgtataaatgctaacatgtagcttttttctttctgtgtctgatttatcttagttagcataatgtcttccgtgttgatttatgttgttgcaagtagcagggtttcttttttttcctaatatgtatatctcacatatatgtatatacatcttatttttttatccatgcattcataatggacacaggtttttccatatcttgggtataatgaataatgcttcatgctacaatgaacacaggagtgcagatatctctttgagatagttattttatttcctttggatatatgcccagaagcgaaattcctggatcctgtggtagtttttatttttattacttttaggaacctccatactgtttcccatagtggttgtacaaatttctatttccaccaacagtatgcaagaatttccttttctctatatcctcaccaagacttactttttatcttttgataataacaccctaacaggtgtgaggtgatacctcattgtagttttgatttacatttccctgttgattagtgatgtggtttggctgtgtccccacccaaatctcaacttaaattgtatttcccagaattccgacatgttgtgggagggaccaagggggaggtaactgaatcataggagcaggtctttcccatgatatcctcgtgacagtgaataagtctcacgagatctgatgggtttatcaggggtttccacttttgcttcttcctcatttcacctcccgccatgattctgaggcctccccagccatgtggaactgtaagtccaattaagcctctttttcttcccagtctctggaatgtctttatcagcagtgtgaaaacaggctaatacagtaaattggtactgagagtggggcgttgctgaaaagatacctgaaaatgtggaagcgactttggaactgggtaacaggcagaggttggaatagtctggagggctcaggagaagacagaaaaatgtgggaaagtttgaaacatcctagagatgacttgttgaatggctttgcccaaaatgccgatcgcgaaatggacaataaagtccaggctgaagtggtctcagatggagatgaggaacttgttgggaactggagcaaagtgactcgttatgttttagtaaagtgactggtggcatttctcccctaccctagagatgtgtggaactttgaacttgagagagatgatttagggtatctagcagaagaaatttctaagcagcaaagcatacaagaggtgacttgagtgctgttaaaggcattcaattttataagggaagcagagcataaaagtttggaaaatgtgcagcctgactatgtgatagaaaagaaaatccattatctgggaagaaattaaagccagctgaagaaatttgcataagtagcaaggagcttaatgttaatccccaagaccatagacatgttagaggtcttcaaggcagccccttccatcacagacctggagacccaggaggaaaaagtggttctgtgggccaggtccagggtccccatgctgtgtgcagcttagcaacttggtgccctgtgtcccagctgctccagctgtggccaaaagggagcaacacacagcctgggctgtggcttcagagagtggaagccccaagccttggcagcttccacgtggtgttgagcctgcaggtgcacagaagtcaagaagtgaggtttaggaacctctgcctagatttccgaagatgtatggaaacacctagatgcccagggagaagtttgttgcaggggcagggccttcatgtagaacctctgctagggcagtgcagaagggaaatgtggggtcagagcccccacacagagtctctactggggcactacctagtggaactgtgagaagaaggccaccatcctccagactccaggatggtagatccaatgacagcttgccccttatgcctggaaaagctgcagacattcaacaccagccatgaaagcagccaggagggaggttgtaccctgaaaagacacaggggcagagctgcccaagacctcagaaacccacctcttgcatcaatgtgacctagatgtgagacctagagtcaaaggagatcattttggagctttaaaatttgatgaccccgctggattttggacttagatgggccctgtaacccctttgttttggccaatttctcccatttggaaaggctgtatttacccaatacctgtacccccgttgtatctaggaagtaactagcttgcttttgattttacaggctcataggcagaagggacttgacttgtctcagatgagacttggactgtggacttttggattaatgctgaaatgagttaagactttgagggaccattggaaagagacgattggttttgaaatgtgaggacatgagatttggagggtccaggggcagaatgatatgggttggctgtgtccccacccaaatctcaacttaaactgtatctcccagaattcccccacgttgtgggaaggacccagtgggagataattgaatcatgggggtcagtctttcccatgctattctcatgacagtgaataagtctcacaagatctgatgggtttatcaggggtttccgcttttgcttctccctcattttctcttgctgccaccctgtaagaagtgtttttcacctcccaccatgattctgaggcctccccagccatgtggaactataaggcccattaaacctctttttcttcccagtctctggtatgtctttatcagcagtgtgaaaacagactaacacaattagtgatgctgagcaccttttcttatagttggtggtcataatatgtcttctttggagaaatggcttttcaggtcctttgcctacttttaaatcaggttatttgggtttgggattttttttttttaatctgatatatggtttgcaaatattaatattttctctcattctttaggttgccttttcactctgttgattgtttccattgctgtgcagaaaccatttagtttgatgcaatctcatttatctattttgttacctgtgcttttgtcgtcatatccaaaaaaatttgttgcccagaccaatgtcaagacacgttttcctatgttttcttcaaggagttttaccatttccagccttatgtttaagtcgttaatccattttgagttggtttttgttatgaataatggtcctaggcaaaaaagtaagaattaaatgtggtgtttccttatctcaagcatcacagccctgtgctatctattgtctaatatctgagaatagttttttcatacatgttatccagttatacagttcttcacaccaaaatgtaaggtccaataatcatatctctgctatggctggaaccacttctacacttaaaatatactttattttattcatttcattctcataacttcatgaaataagtattattaagccattctatggctaaaatgaccaaccttaagtaaccaccttctgttatcctttaagcccatcaagcgtagaaataaatcttattaactttgttgttcattgcatttgactccgttcttggcacacaatagatgctcagtaaataaactttgacagatactattttctcctattttctccattatacatataaaaaaatcctaaatctcagacaagacaaattgtggaagtggggaagaaactaatattgattaagtgctgggatttgaaaactatggaacataggccaaaattggcccactttttgtttttctttgtttgtttgtttgtttgtttgtttgtttttgagacggagtctcgctctgtcccccaggctggagtgcagtgcggtggcgcgatctcggctcactgcaagctccgcctcccgggttcacaccattttcttgcctcagcctcccgagtagctgggactaaaggcgcctgccaccacacccagctagttcttttgtattttttagtagagatggggtttcaccgtgttagccaggatggtctagatctcctgaccttgttatccacctgccttggcctcccaaagtgctgggattacaggcatgagccaccgcacccagccaaaactggctcactttttaaaaaataaagttttattagaagatagccatgctgttgtatcatctctgtctgctttcatgctgtcatagccaacctgggcagttaggtctgcaaagcttaaaatatttaatatccagtccttgacagaaaaagtttgccaacccctggctattatacattataatgccaagcaatgtgcttggcaccgttacatacttttcacctcattaagtttcccagctactctaagaaataaaaaataataccgttatccagatgtggactttgggattcagagaggtatttacaacaggttctatggcttatagatggcaaagcacaaatttaaattctgatttgtcagactctgatgcctatgcactttttatttctaacagtcagataactttgaaaagaaatggaagatgataagtggaatggcccattttagtgatctgcacatcatcacacatgaacaagttgatctaaagctaaagctactgaagaactcgctttataacctataataaaaatagttaaaactattattacttataaggaattttttatatgtcaacctttgagctaataattgtatgtgtatggtgtgttttatgtacatgagcatacatatataacatatatatgctatatataacatagatgtatatatgtatataaatgtgcatgtatataatttaatttatttctcatagatattctatgaagatattgttataggtacagaaataaatgcttaacaggattgtattacaagatagtaactggtaaatcaaggattcagatgattttcctaactcactaattctatctgtatcttctttccattcttttcaactcattaacataggttcccatgaactcaaacattactcgatggcataagaaaggataatatattcaggagctctatggtctcacaaaatgccaaaagctcactttccaaccactcttccgggcctccttggcaagctttccaccatcactcccagcactgtcaagatgtgatgcttttctttcttctcttttttaagtgctttaagctctgagccatcattatttaattttaaattatcttctgatttcctacgtgggctgagaatgagagtagtctagggaaaaaaatggtagtgacaataaaagagaagggaagcatttgtgaaaatccttttcttcttttcaacaagagctgtaatagtgttttgtatcaacatgactccttccttcagctgtaacaaagttagagaaagtgttggtactataaattgagagttcaggaggtgattctacccagtcttttcaacaagattggtattataggtttcccacatagaaaccagtgcagaaatatttctaaagcaattttgtctttgccaggagcccttccctacctccttacgcctcttctctttcccaaaatgttcctaggttattcgatctcctggtgtcttccatgcatgatcccctcccaaacctcagcaacttcccatggtgtccaaaatccaactgctcaaggggcagagttagggatgtaactcaccatttgcccaactagatctttaaataactacctcaaaagagagctctttgataataaacaggccaataggtattatatagacacaaataatgccaaatctctagaacaactaagagtctgatgaaacataacatgccatatctatagattttttttggaggatatttattcgtgtaaagatacagagatacaggtcactgttgtccctcatggatgctctgtaggttgtcttatttttagaaatgttccaaaggtgagatatggcaatggagtaaatgtgtaaaacttaaatgcaaatgtgacatcttctatagccagtcagaaaatttccagtgtattagcaaccatgcactcatttctccaataatagacattgcactaacattctatcccaaagggagcaggagtgggcctgacagcctaggggagaccaaagagttgaaaaatcacagcaaaggaaagtgaaccactaagtgggacaacaaatcccatagggcctatgaagctggccaccatttcaactatatctcaccaaaagtttttaattgagtccattgaggattttcttttttccttgtggggatacatccttgattttataacagcatttaacaaggaaaattggattcattttaggatgaacagctggagcgcatcagttccataaagcaaaagctgacagtatttccattttagtcaccatgtagaagcttctatgatgctcagttggattatgcttaccctgaaccagctcactttcttccagcatgtccatgtacatcaatatcatattccctggcacccaaaccttaactatgcctccttttctcattcatttcccaaaatttagcccaaggatagatgccagccttacagatagcatcagtagctaatcagagttacctagaaatgtagcaatagtccagagaggatgacaacagcgcaagctaagagtcacttgactttcaccatttccctgctccctgcctcaaaggcctgtgaaaaacagatgggggaaatagagtaaattagaagaccatactctttgctacaagtcactggctatatttgataggtctgagagggagaggaaaacaaaaggagattagaattttagacttacatgggctgggctccattacaactaaaaaggtccaaaaagaactggaatcttcttaaaatgttaacagaggacaaaaatggagtaattctgcagaacaagtttaagatagtaactgaaaaacaataaggtatttttcagacttgtcctgtagtaaattcaaactgataaacagatagcactgtttttgtaacttaatttatgtagccaaaacacaagcttagactagtgcagaaaacacattctttaggatcacataagtctggtttcaaatctccatcacttagtacctgggtgaactggattaactcacatctcttgagtctgtttttacatctacaaaatgagaacatcatccatctactgcacaatcatcatgagaattacttgagataatgtgtagaaagtgagtagcacaatactggacacataataagcattcaacaaatctttctattatcacttttgattgcctataatgtgtttctctcattttggccaatccaaatgctatgattcttctgcaggtttgcctttttatgaattcatacttaactatcatattcaagagttttactcaagtatctgcaagtgattgtcaggaaaaagaaagggtggacattctagctacaactcccacagggcaattttatataaaaataaaaagcagattttggttcagtatctgaaattgccttccaacaatttaagctaatcgataataaattagaaagagtgaactcctcatctccctagatagggatgctgctgaatggtgcaacatacggcaaatataagctttggtatctgatagattgaggttcaaatcccagttgtgtcacttattagcaacaaaaccttggccaagttgcaaaacctctgagtctgttcccttaatgtgaaaattggttttaataatacctatctgatcagagtggttctgaagattataaaagagcctcccctgttccctttgccctccaaaaagctgccttggcctctctgggaaccagggtaaccaagaaaacgacaaagacctgtcgggctcataaagccttaggaaaaggtaacggcacgacaatgcctgccagtatcacagaagctggcaagactgtagcctaagcccagctcagagtaggtattatgacacagtcatttacaagataaaaactccttctcaaacatgcacactttcataacatcctcttcacagtagcccttactaccatcatattccacatccaatgactaaaaagcaggagcattttttggaagggatgagaagaaagtatgtaaatgggactttgcttactttccagaagtgctcatcttttattttttctgggcttcgagcatctttttatacaacataattctttagatattgaaaaagtatccaggtaggttcagatgctgtgttatccattacttggaacaacagtcttctttgcaattatcattattgacatgtcaaagtgactaccaatggtgccaaaatcctatgtattaaggaggaaagaaaatgaaccaatatgatagactgagtacacagatttacctcccaatatcccaaatcccttgaagttacagaaaaaaaaaatgctttgtaaacatgattccttcattcatctgacaaatatctaaggctctcctactatgctgtaggtgctacggtggtgaacaaaatatgtggtgaacatgaggtcactgctaaagtggtgaataaaatacgtggtgaacatgaggtcactgatctcatggaacttacattaaagtcaagccgggggagaagagaaaaaaatacaataagcaagcaaacaaataggtcagtgagataattgtggatagtgatatattcaacaaaataattaaaccagaatactatgattgtgagtgactggtagaagagggttgggggactatttcatatgtagcagccagggaaatccttttagaggagataatgtgtgagcaaagacctgaatgatccaaagatccagatctgcaaaaatctctggggtagaatattcccagtagagcacatagcgagtgcaaaggcctagagcagatgtgagcttggcccacatgaagaacagtaacccatccttaaaagcaaagtgatatccatggaccaggaattttgaagaatgtctaggatagaaaaaacaaagggagttggattgccagggaggcaaatgcaaattttcctaagacaaatctgaactaaggtaattcccaagtggtactgtctgtagtgggatgctagacaaaggtcacaggacaaacaaagggcccgtgtggaaagattatcagccaaggaagcacagagtttcctagtatagctcaattcacatctttcaagtgcctcaccttttaagtccccttgaagaaatggcatattttatacattaaggccctttccatctctccctctcaaaaaaaagggagcactgtcatgagatcattccagacaaactctaacattcccttccagatctaaatatgtaattacctaaatttagatattttatttgctgttattttataatattacctaacacttggaaattgtatggtaatattataaaataacagcaaataaaatatctaaatttaggtaagttgtttttctctcacaaataaagaaacaattgaatttcatgtagaaataattgactagctttactttaaaacacacacaaaaaaatattttgtaaatatttatgaacccaccaaatattctaagggagaaaattcaaatttagagattttgattctacatattattattttcaaaaccacttcttctgacctggttagacactgggttgcagaaagcagatcagttctgggcctggtcatgccaccaaacagctttgtgactggggtcaatccacgacatgtctttacctcaaattccgcagcagaaaatagcaaaaataacacgtcctacttacctcaaaggttgacttttggagtcctataaagttaaatattgggaagtgatttttttttttttttacaaataatgtgttattgagctgattatatagccctctcagccactcattcattaaaatgtttaaaattcttactatacgcaaaatcctgaattagatattacagggtttaaggaaaatagcaaacagagcccctaaactccttataatatagagaaataagtagtcaccttttctgagtactgaaacatggatgcatggaaatcatctctgcatttctacctgagaatgatggctgttatttaatgtgtttaaggtattttgattttgtaaaattctgattttagaatacaccccccttggggagaatcttctaagcgagaagttataaagagcccgtgggacatggtctgatctggtagagagagcctgaggaagacttgctcattccgagatttcatgttgatcagttaccttggtctgaaaatagcaaagtgctagaaatacctttcagagagagaagttacatgtccactgaggagggaaaacatgggaaaaggaagatgccaggtttctctatgagctctgtaatggggacagctaatataaattgtggattggtagggaagtaagaaaaaggaaaacacatgcaggttagagtgttttcaaagaaaaatctccacaagtcacagtgactgaataccatgtgtaatgaaagacagggactgtcaatgctgatggagtttcaagcctgcctaattggggaaatgctggtgttattgatgaaggaaaggtacagcatgctgagcccagtgtagatggaaggaaaaggatgagctcagcttggcaagtgatcatatgaggggagaaaatagaacagccaagtggggatcttcagcaggaattaaagacagcacagctggaaattaggtgagagaacatggctgatggtatagatttgggcattatttttatagatgttatccaagaagcagacagacatttgtagcaagagaaagaggccagaaaccaggctgaactttcagaaatgctcagggttcagagttaggggacagaaagaagaaatgccaggatttgaggcaaagatcaagcaaggaagtaaaatgaataagcttggaaataggtagaggggtttcaagacagataatcagtatattcttgagcttcttattcaataaatgtgtccgtaaaggaaaagaaataagatggtagctcaggagggtaccaagatcatgctaagattttctttcaaggtgaaggaaaaacatacagattggaagtctacacagggaaagagtttgaagctaccggagagaaggaataaataaagcaacatcattctcagataggatttagctttagagaaaaataaagatacagattcctttgagctgaagggaagggcaacaggggtaaacattaaaaacggaatagagaatcatttatcactgagtgaggatatggacttcagaagaattaagagactctgaaatggctattagtagacatgtgttaaagcatgaggaaaaaacttgcagctaagtatttcagtgctgaactggggagcaatcgcaaaataaatatttgctgagttccttctatgtgctaggcacatgcatttgaagccgaatacatcttttactagcaacactctgtgaccagggctcaggggtgcagagagtcaaggagaggactacttagtatggaagtggggacagcactgaaggaagtgctggccaggagtccagagtccagagccactcacaaaatgctattcaagattctaataatttttctagttttgttttgacaaaacttaccacttttggcatccctcatttacatctagatcttagatatcattgaacccaatgtttcttaaagagggcttctgtgagattcagcaatgagaccgaacagctccacatttattgattttatatattttggtctttttaatatgtctatgccggcaagatttcttttggttagaagagaataccaaatgatatgttttggatatgtccccactcaaatttcatcttgaattgtgactcccacaattcccatgtgttgtgggaggaacctggtgggaggtgattaaattgtgggagcaggtctttcctgtgctgttctcctgatagtaaatgagtcttacgagatctgatggttttaaaaacaggagtttcccagcacaagctctctttttgcctgctgccatccatgtaagagatgacttgctcctccttgccttctgccatgattgtgaggcttccccagccaagtggaactgtaagtccattaaacctgtttcttttgtaaattgcccagtctcgggtatgtctttatcagcagcgtgaaaacggactacataccaacctaaactaacttaagttaaagaggaagtaaatggatcaaacgactaatagcaggaagaggaaggtatagcagggctcttgggataaaggaagccaggaataccactgagattctctccatctttccacactgtatctagccatgtataagttttacttccttctatttcagaaggacttcttcctcataataaagaacatggcctcagtcagttccaaagtctcttataatcactctctctctctgatccaaggtcaaaaatcttggaggaacagcttgattgtgattactcttgaaattataggcatgagcacaaggactatggccagcctggattgttcagtgtccagccctggctaatcaataagaaactgtggatattttagaaattgtcagctattgctacaaagagaataaaataccaaagaatccaacttaacttacaagggatgtgaaggaccgcttcaaagagaactacaaaccactgctcaatgaaataaaagaagacacaaacaaatggaagaatattccatgcccatggataggaagaatcaatatcatgaaaatggccatactgcccaaggtaatttatagaatcaatgccatccccatcaagctaccaatgactttcttcacagaattgtaaaaaagtactttaaggttcatatggaaccaaaaaagagcctgcatagccaagacaatcctaagcaaaaagaacaaagctggaggcatcatgctacctgacttcaaactatactacaaggttacagtagccaaaacagcatggtactggtaccaaaacagacatatagaccaatggaacagaacagaggcctcagaaataacaccacacatctacaaccatctgatctttggcaaacctaacaaaaacaagaaatggggaaaggattccctatttaataaatggtgctgggaaaactggctagccatatgtagaaagctgaaactggatcccttcgttacaccttacacaaaaattaattcaagaaggattaaagacttaaatattagacctaaaattacaaaaaccctggaagaaaatctagacgataccattcaggacagacgcatgggcaaagtcttcatgactaaatcaccaaaagcaatggcaacaaaagccaaaattgacaaatgggatctaattaaactaaagagtttctgcacagcaaaagaaactatcatcagagtgaacgggcaacctacagaatgggagaatatttttgcaatctatccatctgacaaagggctaatatccagaatctacaaagaacttaaacaaatttacaagaaaaaaacaaacgaccccatcaaaaagtgggcaaagtatatgaacagacacttctcaaaagaagacatttatgcgccaacagacacatgaaaaaatgctcatcatcactggtcatcagagaaatgcaaatcaaaaccacaatgagataccatctcacaccagttagaatggcgatcattaaaaagttgggaaacaacagatgctggagaggatgtggagaaataggaacgcttttacactgttggtgggagtgtaaattagttcaaccattgtgaaagacagtgtggcaattcctcaaggatctagaaccagaaataccatttgacccagcgatcccattactgggtatatacccaaaggattatagatcttatcttgctactataaagacatatgcacacgtatatttattgtgtcagtattcacaatagcagacttggagccaacccaaatgtccatccatgatggaccagataaagaaaatgtggcacatatacaccatggaatactatgcagccataaaaaaggacgagttcatgtcctttgcagggacatggatgaagctggaaaccatcattctcagcaaactatcacaaggacagaaaaccaaacaccgcatgttctcactcatgggtgagaagtgaacaatgagaatacttggacacaggaaggggaacatcacacatccgggcctgtcagggagtagggggctgggggagggatagcattaggagaaatacctaatataaatgactagttgatgggtgcagcaaaccaacatagcacatttatacctatgtaacaaacctgcatgttgtgcacatgtaccctagaacttaaagtataataataattaaaaaaaaagaaattgtcagctaaagtgaggaaagaggaatagttcccagaaagagggaaaagaatttgtattattaggatgaataagtaaatgttaatagatatgtctgtgatctttttggcaattttattaaggctcactagatacggctttctttgtatttatccagaatattcataagttgttgaatggataaataaattatatttatgtatgcagtggaatactattcagcaatgaaaatgaatgaactacagttacacgcagcatggatgaatctcacaaacataatgttacgtaaaagaagacttaatagcaaaataacatgtactacagttttctatttattagaaagttagtctgtgatgttagaggtcagaagagctccatacacagctaggatggagggcaccaggaggctagtattgttctattcctagatccaggtggtgtcacatggatatgtttaccttgtagtagttcattaaaccatatgcttataatttgtgtgcttatacagtatgttatacttaaataaaaactttttctacaaaaatgcttgttagcaatgttggggggtgggaaagaaatccgctcaatttagcttgaataaagattgccactattaagaatcattgatgtaattctgtcccctattcttctgcccacagttcaacatttttcctactcctcagccttatacttggttgactttctgctgtagagagtcagactgggaaaaaaaaagacacagacatatgaaatgcctgttcagagataatcagtaacagattctgaaataaaggctgtctttgacttccaaaccaaaatctagaacattccaccaatctaccataatatacacaattctactagttctgttaccaaagattgcattcatttattcactctgcatttattataggacagccagtcagggagttctcattctaccggcctgcagcccagggagtgctggaatggaaatatgaatagagtgctgtataacacatgcaggaagccattttatacctggtggataagggttgtcttcaaggaggtatttatatgcgtatgaaatatacacatacaaatgagaaacatatgttcagtagttaggtgggtgaactggtgcaatactgcccagattaaaactttggccacatcacttacctgttaggcagtatgatctgcttgaccttagcacagcctttttgtgcttccgtttcctcatttgtaaactggggacaaattatggaagttaatacatgtaaatggttaggaaggtgctatacacatacaagagtactaagggtgatagagggctcagtgggagaaggctggccttagtggggaggggtattttatcatggacattgtttataactgccaacatatggtagtgagaaaaagtagactccttttttggttttattattgttttttaaaactctatagacaatgtaaccccttattgccttcatctgaaggaaatattcccacctccccaccctccaccccctgtactgccaggtacacagaatgtaccatataagtgcttgctagtatcattgttattatttaggtatggaaggccacgtaggaattcccagaagaactgggagaagggaggtggaaaggaccttcctgacggtggcatcaacacatgcaaagacaattttataaaaatactatgttcattcaaactatcagttaatatccaagccaggaagggaactgggctttcctgagaacggtagtgccatcattgggaagaaaaacgaatcattatgagaatttcctttgatagtcatcactgaagtccactcacaatttcacgtgagattcttctgcttgcaattaaacatttttcccattcctcagcattacacttgtttgtctttctgctctagagggtcaaggatggcttgaagatatccatccttgagagcgcaattctgccaatgagctatttctgtgcagtgcttcttactccgccaatgtgagcacctactttaataaaaagaataatcaactgctttgtggtttaaaggattcttaatgccaagacttcagagttcttctctataagtgcaattaagtaaagggagggacaaagcccagttaaataattcataaaagcataactacaggaaaaaatgtttaacttatagtttttccattaaccagtgacttggctccaccaagttagaggattcctttacatcaaggacccagcataccagaggtccccaaccctcaggctatgggctgttatcaggtctgtggcctattaggaaccaggccgcacaacaggaggtgagtggcgagcaagcattactgcctgagctctgcctcctctcagactggcagcggcatcagattctcacaggagcccaaaccctactgtgaactatgcatgtgaggaatctaggttgcatgctccttatgagaatctaatgcctgattatctgaggtggaacagtttcatcctgaaacaatcccccaaccccagtccttggaataatggtcttccacaaaaccagtccgtggtaccaaaaaggctggagacaactgatgcataccattgtatgagtccacatgaaaggcaagacttgtcttactggagtcccaggaggactaaatgaaaggattataagagaatgacagacattagcacatcacgtagatgacttaggctcccccgtcccccacacacaaaacaaagcaaaacaaaacaaaacctctatttcagctaaaattaaaaataagcaatatatttaatcaatttacactagcaagtaaatatcacttgtaagtgtaatatgactcctccttaggaggagcaccaaagtagaaagccaaacaaaacagactaaatacaatgagattatctagagccaaactccagaaatgttcccagtggagactgtggaatagacaaaataaattttaatccatgaattgtctttatgaatcgacaaagctcagaacattatgtagaagaatttgtgaaaaataaaaaatattttttaaaacagtaaagtcccagtataaagtactccaatagacagtattctctagcctaggccgaatttcctatcccaacataatgcttagcagtacagcacctgcagccctccaccttggtttgcatcctggtcttgccactctcaagttatataaccttggacatgttagttaacctctaagagcttaaattaccttgtttataaaatgaggttaatactgctacctatcacatggaggtttactaaaattaaatgaagttttggcagaaagcacttggaacagtgcctaaaacatagtaagaattctattaatgttagctacctttttttaaactcattaactattacttcagcacaggtgcatggccagtgtgcttgggcaggcaaaaccttagtgaaattttaaaaacaaaatgtaatttgtgctgtcagaacgcccaaacaggatctcatgaatccttgtgatgctcatgagaacaaaacaccttacggtgcagtcagatcagaaacatcaggctctaagaaaactcaggaaatggaaatctcccacgcacccttgaatgccacatacccagacttacctcattaccttcttatccctctcccatcccgtttcccatgccctggtctttctcctcctacttctcttattgtctatatcttaggaaatagcatagtccccatccaggggcccagttgaaattctagctagtcagacccctacaagtcaactgacatttcattcctgccttaactccccatccctagaacctctaatacataccttggaaatagttcattttcatccactcctcttcaggcacactgctgctgccctgggctctgcctacactatttctcagctgagctgttgcaatagcctccttatgcacctctctgcttctatgcttgctccaggccaatcattctctataaaacccttggagaaaagtttcaaacttacaaaaccaatcatggcacttccccaataaaaatttttgtttcttttgagccacctcccttctcctctctctactttgaattccttccacaccactggccctattttatcctctggccacaaaaattcactgcaggtgcccaaatctcccacattccctcttcgctctgtgctctgggcacatgccctttcctcttcccagtaagaggaatacgagttgagaaaacaaagacagctatgaagaaataagaaggaacaaagaaagtctagcatcacagaacatagtaaataaagaaaaggttgttttaagaattggggaaggaaataaattgtgtcagaggcagaaacaaaaataagaactaaggatttggtcacaccgattactgcttttgttctctcgatttctctattcagaaatctccaactcaccctacaagtcccagtccaaatgttgccgcctctctggagccttccctgacttctgtaggctgccaacccagatgttctactttcccacatttatagcattatacacacagctccacaaaacaatgttctaaccatttttatactggcttccttgcaggaatatcctccagcactgagtctggatattgcagaccatgacaatgataatgacagcagtgcaataataataatagttgtttcttttgttgataatggcgactatttggtagactctaggcactttgctaaggcatttattgattgaattgcatagaattgctgtgtttattggccaaaagggtcatatattatgaccaggtcatacctggtaatttcaggtagttcagcctaaaacatgcactgttttcatcttcaccacaatttgaagaggcagatgtgttattatacccattctatgagaaacaaaattgaggttcagaggttttaagtaacttttcccaaggtgatataacagaaaagtgaagaagcccagaccctcatccaggactgcctgactctcagcactcctaaccagtattatattctgactcccagaattattagttaaattggttaaccaactaaagcaataatatgggggtctccaaagataatggttgcctagcataaagaggcaagttggtgttcacggagtctgggtaggacaaatcctgatgttcatgtgtgagttaaaacaggcttctctgcagcaagcgaaggctgttaaatattgaaatgagctaataaggaaggttatagactctccttcaagagaaggatttcttcccccaatggagaatagattctatctgtctgagatggcttaaatataatcctttgtgaaggtcaataaattggcttgccaagtcctttccaggtccctgatgatactcggatacactggctcaatgtggctcagtgcgtggcctgaaaatggagggtgctgaaccctgagccagaaataatctcttccttttttaaactcacttcgccctctgactcgtccttctttgtgacatacgtggtgaatttgtacgttgttctgatttctgctgaagaaaaatgcatctaaagcacaaagcacgtgtgcttcattttgacatctcccggagtgcccagcacagtgcttcatgctacatttttaaaatgtgatcaaatggtgcttctttttgtcttctgaaagaatcctatagtatcaactgaaaataaggctgttatttttgtctaaaatttattgtcaaaattaaactcacagcataagaacaaagctttcttaagtgtgcttttggtttaaagatgaaccagtactgtagtcaaaaagaaagagatctggctagattactaatagataatagcacatcccaatatctaagcaagtgtctaacaattcccaattacagtcactaccatctcaaaataattatagtggaaaagtctttttcataattgccattccataagaagcataactttttataatttttagtaaataagtacaaaaaattactctagatccttattctcaataaaaataacaataactacacttgtacagaacattaaagtaggaaataaaacaaaattccttcaaatggtttggctcatttgatccatataacagttcttaccatttatatcaccactccagaggatatttacaggaaacttggatcagagagatgaagaaaattgctatgagtcacaaagctagcaatagcagggtctagactaaaacccaggcattttcctggtttcaaatttcataatttttccactgcatccacatggccaatcttttttttttaatgcatttttacctcagcaatatagttaatcaagtttcagagaaagtgaccaatttgctgaaggaggcacattttattacttttggtaattgagcttgaacattaattactcacatcttataaaaaaaaatacctgtagttaacagttattgagcatttgcttcttgccactgaactaagtgctttacatggagtatcgaattcattccttaaaagtctggaaggttggtcttccccttttccaagtgtggaaactgcagctggcagagattaagtaacttttccaagttcacatggttgggaaagttaagtgggagagcagtggtctgaacccctatcagcggaacccagaatccaggctcttaaccaccatgttcatctgctatgctactggttctcagggctttgtcctgggtagtcagcatcaacatcactggggacttgtaagaaatataaattatctggccacaccccagacccactgaatcaaaagctccaagagggagctccagaaatctatgttttaagccctctacgtgctcccgaggcacactaaaatttgagaaacactgtctaggctgaaataagagtagacagtagccatttacaaggattcattatacattctttgctatcagggaatgcaaaaaggaagtgagaagttagggacaactgacaacgttgttgaaaatcttcagaggatattaaagccaaaaagggaaaaaataaccttaactagtgcatgcagaagctgaaaacagcaatgatgaccaattaatcaggcaatatgttacactgtaatcaaagaccagaaaactccggaaggactaaatgacatggagtttattactgcatggtaaatgaccattaataaaacatggctgttaaaagaactaaggagatgaataactgtagaaagaaatgtcagctgtagaaggaacaacttatggtcttaatcacttggagaaattacaggtatggacacagaataaaaagaaaagaatggaaattcactgtgctataagaaaaacatggcatgaacctgatagctattttaatacaaaatcaaggtagttacagagacactacacactggttaatgaaagtttgacctggctaacatttcaactgccaaaaataatgaatttacataattttaatagtacattgtttggcaaacattcccatctctagtatggaaacaagaaactctcttggagttgctaaaatgtaaagattacttgactgggaatttatcttgcacccttggttattccttggattcatctggctgaagacctccactgacctgtaatttttttttaaaggactaactgcacatgagtgcttctgaagagaaaaccaagagcagcttccaagggcatatccttccaatatcattcattatatctctttagaggactgctttttcaaagtacaatgtggagggactgaaaagtgacatcaagcaaaaaaagcatctaataatacctgcaagggagtataaaaagaaaaaggattccaacagagataccaaaagtcattatacaacataactgtgagttatttttttttcatttgatggctactgatttgaggtctttaaaaaaaaaaaaaaaaaaacttcagttgtttaagaggaagcaaatcaaagagaatgcattcattgaagctgtcaaaggaaatattaaccagtaaaattgtctaaatgagatttattaggaaaaagtatgctcttatctaactcagtgttttgtaacaattttccattcccatattttaaaaaattaactaaaatgtattgactgcttactacatgccaggaatcatttaagcttattatgtgaattatccttggtaattttcatagcaactctattacatataactgtttgtgtcctccctccaattcacactttacagataaaaaagttgaaggcagatagctaaagttacaggtggtatctgttctccaaggacagccccaaataattccatctcttcctatatatacaagctgctccagccacaataaggtggaactcacattcctccgccttgaacctgtgctggatctgagactgatttgaccaatagaatgcagagaaaaaaaatattataaatcttccaagacaggaattaagaaggcctggcagcttctacaacttgaaatctagccaccatgttgtaaggaagcccaagaagccatgtggagaggctcatgtggagaataatcaaggcccctggctgataatttccactgagctatcagccaacagccagcaccaacttgccagttatgtgagtgaactatcccccagccccagttaaaacactctagctgatggtgcatggaacatagataagctgtctgtctccaccaagctctacccaaatgacaaaaatcattgttttaaggcaccaagatttgaagtgatttattgcacatcagtagataactaaaactttgaactacccaaagttatagagagagatgactcaacattaggtaggccatagatttcactctcaaatatattaacaaactgcacatgaggatgtacaatggaacaattccaatcagaggcaagggtgaataaagatgttcatatatggacattttattcaacaagcattcattgagaaccactgaggaagcaggcactgagcccaaatgtgctggatataaaggtaaatagtcagaaccctgagctcaaggaattctccatgcaaggccactaagaaaaaattacaataccagaggaaatgaacaaattggtgtagactaacaggtagattcttgagatcacttggcgacctaagtaaatactgttgattttcttatatctaccctaaggcaaggaattataggggaaaaacttagaatgagttgagagtaggggtatgaagaaaagttgcacttagagaaacaaagtaaacttgcatggtacaacaacaacaaccacaaaaacactatatatacacacacgcataaatatacacatacacatataaaatggaggaggaaaggcaaaatgtgataaatggttattaggagaaggaaaattttgtgtgtgtggacaagcgcgcgcgcgcacacacacacacacacacacacacacacacacacacacacacacacacactactcctatggcacggtccataaaaacagtttgatcaaagtgaaggtcaaacaaagaggtttttttaaatgaattctagactggttgtggtggctcatgcctataataaccagcactttgggaggccaaggcagaaggctcacttgaagccaggggttcaagactagcatggacaaaatacgggacctcatctccacaaaacaaaacaaaacaaaacaaaagaccaaaagtattagctgtgcatggtggtatgcacctgtagaaccagctactcaggaggctgaagtgggatgattgtatgagcccaggaggtcgaggctgcagtgaactatgatcacaccactgcactccagcttgggagacagaataaaatcctgtctcaaaataaataaataaataaataactcttttttaaaaaacagggactaccatttccagacaagatgggagttattccatttccccctcttacagaagcagaaactcttcctcttacaactagaaaatcgtggccataacagcaccaacaagctgactcaatttctgaaagaggaggaaaagacagtctgcctagcaatctcaggacttaagaaaagacactgtagtaagtttccctccccttacttcccctagcccctcatatatcccagacgtggcactgcagaagcttccaacaagagaccgtcaacatgcacagaaaaagcctactctcctcagccaaaggactaggacagggtgtccaaccaacagaaatatttatggcaataccacctcactgcagccaaatcctaaagaaaaaactgcattcccccatcctgtggttttagtgaggctgagtacagcgctcatcttccacccacctataaggtttctctccttatagaaaccatcagtgaggctcatattccccacatgggtagtttcttgacccctaatagaggtctggaggcaagaggagcctcttgtccctaccaggtaacaaaaaaatttaaaggaactgtgagtccactttcccctggccctgtggcagtgaagcccagtggaaagctgaaacatccatgcccacccagcagtaataggaggtatggggctgggttagttggaactccttgtcctgccatcccctctttttattttatttattttttttttttttgagacggagtctcgctctgtcgcccaggctggagtgcagtggggcaatctcggctcactgcaagctccatctcccgggttcacgccattctcctgcctcagcctcccgagtagctgggactacaggcgcccgccaccatgcctggctaattttttgtgtgtaattttagtagagatgggatttcaccgtgttagccagaatgatttcgatctcctgacctcgtgatccacccgcctcagcctcccaaagtgctgggattacaggcgtgagccaccacgcccggcccatcccctctttttgtgttaaggacacccagccaggagctgggcttccgtcccatcctgcagcaacaaagcaatgtgaatcagtcctctgctttcctccctcgctgatgatgtcagggcacagtcacagtcattagctggtcttacacgcccactcggaggcaaagaaggaatacgaattaataccccactttctctagaaacatgtcagtggggctaaggaaagagctaaatttttaacccaccaacctgcagtaaggcagtgtgaaccagcacttcacttctgctactagcagagcccattgggaagctggacacatactcatacccagccctcaggctacacctcaatagggggactatgtataacactaaaaaaaaaaaaaaaaaaaaaaaaaaaagattaaatagaatccagagtgccacaatataacatccaaaatgtccatgatacaatagaaaatcacaatttaaatagaaaagatatccacagccatcaacaccaagattaatcagatatcgaattatctgacaaagatgttaaagtaaccatcataaaaatgcttccatgagcaatgatgaattctcttgaaacaaatgaaaaaaaacaattatcaacaacacaatctcaacttgttaggtttatataactagcaactatggctgggacatctgttctttctcaaaatcagaagttgcttattctataacgataaggataatttgtccacctgaaaataattacagtgctgactctcattttccaagaacctaagaaattattacgcaatttaatcttctaaagaccccacagccaacatgatgaccagaagttaacttgattgtctgacattagttgtttagccatttcccatcaatttaaccctgtttattcatttgcctagcatctattttgaagcttcaaacctctcacaaaaatcctctagcacatggtaaatggaagaaacagtgagtattttgggcttgacactgacttttatttatccttgacaatgataaaaatatacctcttttcttctgaaaaaaaaaaattgtcaaatgtttgctgtgggataagaccttaaagagagaaatgcttccaatggtctttcttcattgttttaggtttgtatgatatcaatcaagaggtgccccaaagtgaacctttgcttaatacctgccataattctaaaatctatacatacagtctttgtgcattaaacacctttctgtcttgaggcattttctctcgaagtgaaaacactgtgaggaattccatctcagggatgagtgccctgttaggattcaaaacacctggctccatctgacttcactgctcactgcccagtgtgacttggggcaagtctttaaacctctctaacctcgtcttactatttgtacagtgtagataacccacctatctggtccacttggcagagttagcaagaaaaataaaatgctgcctatgtggatgatttttgtaatgtaaggagctatacaaatacaagtgattcgtattactttttggtagaaattagtagaattgtatagaaacttgttgttacgtcaaaataaactcttcagtaattcaaacatacaaataggattttaggggcatctggggagctagtaggtatatttaaaaggaattagagagactatgagagggaagatgggaggttgccataaacaggttttgcctgcacctcagatgtccctgagatacttaattggaatgggtggtccttcaaacaggtacagtggaggatatgctcaggaccaagacaaggctggaagctaaatatgctgtttctggcatgacacctggatccaagggggtgggcaacctgaaagtgccatcaattatgtacacagtatttccttgcaaggaaaaatagaaatagtctggagttagtctttcaccaagattggcgggtaggaggcattaagatagtcaagaagaccaagctaatggataaatactacgggcttcagtgcctgccatcatcaacctgcttccttaactaaaagttatgtattccggaaaataatgcgaaaatcttgttgctattgaagagcagttaaaggcagataaaatctcaacgctgtaatgtgcattcagttgtttcaactccagggacatacaggtgttaaggtcaaatctcagggaagccaagtgcccagcactgtttctagccagttgtcctctccccagtcaacttcgagtctctgtagagaatcatagttttctttcagaaactgctgtgcctacagtcactgaacaatcaagcatttgtgttgttactcctcccagggatgtcaaattagaaaacagcatcccatctctgggtgatctgtgttgctgtgaagttgcaaatgaatttgttgtcttgctttaaaaaaaaaaaagtgctcacatgtatacctatgtaaccaacctgcacattctgcacatgtaccccagaacttaaagtaaaataaaaaaaatacaaataaaaaagtggtaactcatgtaaaaaaaagctcaaaaattatagaccttcctcagttaatactattcctggagtgtgttaaacacttttccccagttcatttttgttaaaaagctattcccttttcttccaccccaacccctggaagactgcagaagttacaggaaaaagtactggaatgaatgtccaaaggctagagtctaattttattccattactaacttactgagtgactgaccttgaacatgtctcaacctctttagaatattgatctaaatattatacgtatttactgtctgtggttggctgacttttttctaatttgctttactcttttgttggcatctgcttctatatgaaaaaaaattactggtcttggcaaccatttcctgaaatagagtttaattttcttacagccaaactatatgtaacatcactcagagtagtgactcgcactacagtttcacaagtgtgtatatgtgtggattctgataattttgtactctgtaggggaggaaaagaaatacaactcaagttgagaagaaaaattatcctcaaaaatgtttcgttatcactgtttttagagacttttgttaaggttagagtttgagatagcaccaaggtggtaaaatgtgcagagaacaatgataaagtctcaagtttagcagtcagaaagacctgggttgaatctttgtctctgctacccactagctatgtgatttttacacaactggtaagttggtataatatctagcttgcaaattagattttctatggcaaatataatgcaaataaagtccttacacatataaggaactcaataaatggtgcttttataatgatgatggttgtgatttctgggggcagaaggagaacacagaaggaggagaacaatactttgcttctgtagcagcaaagtcatcctttgtcagaaaagggctttcagttcggttctgtagagccttctaagggggactgtaagctacaactcatcttaagaatttcaacccatgtctcctgttttctttgcaatagaccaaagcataccctctaagattccaaagtgtcccccatgagcttcccctgaggatatttcctcacgagaagtaagaaaaggcccatcctccaatttctgggacctaagatgatgatcatagcaataataataataaaataatgcttaccacttattgggttctttctatagaggccaagcactttactaagtattttacatatattatcttatttaatcttctcatcaattttgtgcataggtattatcaccccattgagagataaataagaatctcagggctcaaagaggttaataactgaaagtgccaagattcatgctccactttcttattcactactttattctgcattatgtgctacatgaaaatacttagccttgttaatacttaacccaggctccctggctgctaggattttatgctaaattgtataattagaatttcaaatttagggcagtgactgagaattattatacctcaatatatgaccttacaaaagtatttactataataaatttgtctgcactatcttttggggaagtctacagaattctaaagcagagtcacacacttaaacagaaaagaaatagaaatgagactatacttttttaaaaggtgctcaaattaataattaatcttttaaatttttaattgacatataattgtacatatttatgtggtacagagacacatttctatgcatgtatacaatgtgtaatgataaaatcagtgtaactggcatatctaccacctcaaacatttatcatttttttgtgtcgggaaatttcagaatcctctcttacagctatttgcaaatatacaataaattattgtttactatagttgctctaagtgctagagaaaccagaacttattccttcaatctagctgtagtttgatttgccaatatatgtgtaaatgctatgtgccaggcccagttataagcatcttatacctattatttaattcttaccacaataaaaaattctatgtgtagatgctattaaaattcccattttacagatgagagaacaaaggcacaaaaattataaacaactatttttgaaagagttgattaaacacccaggacaagaaaaagtctttaacaagcaaagaacacagatgcaaatgaaaaaatcaatcttatttataaagaaaaacaataaaaacaacataggagttgttcctcgagattgaaggatattagtgatcagtttacaaataaattgggtttgcatatcttagatatgttggattttacactactgagtcagagaacactctcattttgctcagatttagtcctcagagatccaaaataacacccaaattgctacttcacacatattatcaacatttggtcttagatctctccaataacttttctgtatttctggaattgtttcaggagatccatcgcctaggtttcataacatatttaattagttattcgttcttattttgttacaaaactcaacaaatgggttgtggcatcttcatttatagaatgaacactttcactttatgaaattggtgctacacactaagtcatctgactattccatggtcaaccttcctcttcattttaaataaatcgtttccagcttgtactgcttttaatgagattaaatgaatagagacctagcctccttttattataaggagttgatcgtttcaaatatccccaaagtcatcttgaatctgtgagatccactgcctgccttttgtaatacttaactggaatgctttattccaagaataaagtggtgctcaaagtcagcatttaaaaatgttatcaaacagatttttttaatgttgctaattgcccttctcctttctccaagaaactgtgctagccttaacatacattgccacatatataaatactaaatgcttattaaaagacaggcattgtgctaggtgctggagatacaaagatgtttaagatacacccacaaagaactgaacaagacagggcaccaaagccactcagctgactgtcatcttgaaattatggattctgtgtcctaatttatcaccctcattctgttctagcctttctgatgcttggcattaattttccttttctgagcactgaccccacctctcctattctattcctccactgttgaaccggaacaaaggtcacttgaaagcgaagcaaaactcagctgttaccaaaggcgcaaagatcaaagttggcagctacgctaaagttcaggattcagagacttcctctttaagatcaaaattccagatgatccaaatataggcaaatgagccccagtagaacactcagctttctgtgctgaatccaggaaagaagcagaaatcaccatagaagcaactcagtttcactctttgcaaccccgtgggctctatgctaattgcctaccccaagagtgagatcgcatttcaaaatatggtcaaacgcaaaacagccaagtcaatcaagcattaagtattcaagcacaattatccgaacacatgcccaaggaccagcagtgaagcagcttaatttgggagcggctccgtaatcatctctccgggcagctgagattttaacctctcccctcgggcctcctgttcggggcactaggctagctctctctgtgtgagagatcacaacgggagccgctgccccccagttgtgaggcttcatttaaattcatgctaagggtaagggagggggagggggcagaaggtctgcagaagcccccattgttggggagagacgtgtgggagcagatggtctggctggtcactcagtctggctgtcagatgctctctgtcaagttccctggggactgcagggttttctttccactctccgctctggtcatatgtgtttgctcagcgtgagcgaggggtctttttctttatcacccctcagacttccagggggctgagttgccttctccgtcccccactccttccctctgctttctctgctttttctggaccagctagtgccgcgcctccaagggcccgctcgctgcagagaaaagcaagcgatttcctttgtctctaattgatgctgcgctctcatccagcagcttctgactggcatgctcactcggttatttaacaaattactccacagccctcattagaactattgacatgtacagctaaccaacccctacagttagggacgatgtggtaaccgacttccatcatcttcgtggctccttttacttctgtcctgcaatgggataagcagatagaccttcagaggtttagtgggccttaatactcaccttttatattatgtcagggtctaaaaaaaataaacagataaaacatgggttacagatgcgactcttatttgcatcagtaagggacaaacacggagtcagcttttctacatataactctgtctctaaagcattagctgttgaacataaatcttggcctcaaaacctgctcccttttaagattccacacagcttgtgccaaggcagctattccttgcagttctcagttaagattttccccagctcaggaggctgttaaattttagtttttagaccatactggcagctcaggactcactaatgatgcctctgtcagctggaggaagtcaatgtcagcccagagaggatagtgtctgagattgggtggcaaagtgaaagtgagaaatatcatttgatcccctcatctggctgggattaatgttttcctttcataagttatcctctggaaataaacgtttgagtgtttccatttacactcatcaacagaattttgttttcgtgtttatctccctttctccccaaaattatagaaacttgaaagcagagattgtagtagtcgtatttattggttcaggatacagtgttatctcttcagagtagctcaataaatgttaaataaacaaatgacagaaattaacaaatactagaaattaacaaaatggaatataagaaaatgtaaaagaagactagctctaaactaaatgtgaaacattttttccatacccccactattctagatattcctgtatgctacagcaaaaaccataccattttactgtgaagtaaaatggctgtgaagaattaaacagaaaacctgactcactaaaaacttatagtctaaaagatcaaaaactctaactgcccaagtactaatgtcaggtgaagaccagcccacaagctagcaacttggacaagcagttttgcaagaagtgcaattgacacatctgtgagggatgggacaggagcttaccaaggcctgtaaacctcacccagttatttgcatgagccctgagtagacaggggttacatgcaaaagcagaaggaatggattaagtgcagggctgctttagtgcccaagatacaaagtgtgacacggagagtgggggctgtcttcccctgagtagcactgctgcaggagcttgagcatttacagctttcagaacctcaggggatggcatctttagcacagacatcaagcttcttcattgaatacttgttgcagtaagataccaagtagcttaccaggacatcattgtgggtggaggggctgaagaaaaaagaaaaggaggaaatggacacaacccattgtagtacagaacactgtgcaaacacccctaaagaaagtcaaaaattgaaaacttaaggaggcctgcctatataccctactttagcagataaaggtgaaagccaggacatattgtttatgcacacttacatacatacttttctttttacggcatgttagcttttcttttcatgtagacataagtaccagaaaacccatcttgcacatataacaatacaccctccaatttgaaatcatagaacactctttaggagtgggtatctctatagtttgtgttctataattttctaagaaagacttctctaatccattcaatctactgttttttacctttacaaaagtctttttgttataacatgaaccaaagagaccactttaaaataagatgagcaaatgctctacagatagactgccaccatcccttctcatacccgttacagacattgctggtcactaaaggctttaattctagccttcaaattctgctaaagcacagtataccagcagcttttaccaatcaatctgtgctggtatttgatattgctcctatttgtcaccttctttaaagataataatcacatattgcaaatattaaagcacaggaagtgagcttcattgctcaagaggcagtgagaagactatgacacaacttttactatcaaaagggcatgtccaccattgtcaggaagtgctcctggtttccacaagaagacatggaatgtagcctgtgggatggggtagaggatcatgatgggaggacaagcttagaaaaatggtaacttgacatacttacatttgtgtgtgtctatggagatagtgggtatttggtagcattgaggaagctgaggagtcctaggaagattttcagggaggtagcttctcaggcttggcaggctacaggataggaataggaagttgtttctccttggccacatcttcctagaagtgataagggaaagccttggatctcatttcctttttcttggacaggaccttcatattagcatacaggccccttaggtggtatgttaatacataagaaagtccatgacagaaactaacaaaaaacagtcacaacacagagtgccattggccaggagcctttgctgcacactgtcaagaataagaaatttgaagagcaggtaggttttgttttgtggttcaggtttcagctatcatttgagtgctatgtgctttgtatatattaaccacctcacttgatccccacaactgccctgtgaattatccccatttaaaaataactaagacccaggcggggtacagtagctcaagcctgtaatcccagcactttgggaggccgaggcgggtggattacgaggtcatgagatggagaccatcctggctaacacggtgaaaccccgtctctactaaaaatataaaaaattagccgggtgtggtggtgggcacctgtagtcccagctactcgggaggctgaggcaggaaaatggcgggaacctcagaggcagagcttgcagtgatccgagtttgtgccactgcactccagcctgggcgacagagtgagactccatctcgaaataaataaataaataaataaataaataaataaataaaaattaataaaataaaataactaagacccaatgaggttaaagtcatagagcccgaagtggccaaatcagtattcagattagaacgggtttgtggcaacaaagccagggttctttcaccacacactgtaaacccatctcaggggtgaataacctacacacctagaatatctttaaggcccatccatgcttcttccttctctctctctctctgacatgagctttacagggacttctttttcctggccaactctgtttcatgtgccacatctgggtctgagaatggaacaacaagagaaggacagtctctatggcttaactttccaacagtagaaaagaattgaaggcacccttctctgaagtttcactccccttctcttgtccagtgaatatctaaccaggctgttaatagcctcatttgtgggtgtctatgtttgttttacaccaaaattacatatgattacattaaaattatgaatattcctgattggccactcattgatggtagtatgagacagtgaaatggaaataaaattattctgagatttcagctcttcaacaaatgtacactgacataatgttaatatttaacagctggtatgaatcaggtatcaaccagagagagtgtacaggccctgggggctgcccagctgtgccagacattaggaacctcttaattgctgaaatacagagaaatgtggaaagatggtagagtacaatgagaagacccaaaggagcgacccagtagcaagaaagttttccaatagtttaataattggtagggtcatagaggtggtgcaacagtggaacatcagccctggagatgcttcctaaaacatgactcacggtaacacaatggaatgttttaacatgtcaagaaaattatgttgacaaaaaatggggttagccaccctgttaagccacctggcatagaacatggaggccaatgccaacagctgcactcatcttaatgctaatccaggagagactttggtccattcatcaggattcatcaatggtggagatgggcccagctggctctctaagcctatatccattaaagagttaagctacctaagtaatcccttcactctgcttccatatctattttaaaatttattttatttgaacttctgtgctgctttttctctgtgaaacagctaagatgaaaatatttttacacaatcatgttgagcatgttgagcaaacttggaggaagtagtagatgtctattacattgctgctttcagcacccttccctgatcagcttcaagtatgataattaacacagatattgggcaagagaacattcctaggaaaaagtttgatttcactatgcctagtatgtttaacttggaaagtcctgaaggaactgtttcagtgataccagccaggttttgcattaaacatgatagttatggggaaaaataaaagaaggagagtgaaattattttccaagtgctggtaacactgaaaatgtaaacagattcaaggagggtttggtaaatccagtgatgtaaaatctgaacagattagtgtcctctcaagtcctttgagacttgtgtgttagagattttcttcccaccaggctgatgctatgaaaagggattattaggcaagttgaaaaattacaacccatttgatgatatactatgggactgtgaaggttggtggcacaaaatgcctgataggaccaaccaaacgtcccatttcttaaaacctccaacctccacatgttctaaggatgaagggtttgaatagagggaatcagaggcttgagcaatcattggaagggctggggcagcaaggaacagacaagcatttgctgaagatctctgccacaacagtgagacttgtgattcccaagaagctgctgcaaatgtcaagaacctccaggaagctccctctccctatctcagccagaacatgcaactaaagattttttaaaagccgcattgtctacctccactgcctggatcacaaagcaggtaattcacaggagcttgctataagcttctgcaaacctcctctgtcaccggttcacaaatctgcatacactgcctctggagtataatggcctctttttctgttcaccttctaaatctgacatgattggctgtcatgggcagaccctaacttggaaccatgtggggagggggatcctggaagacatgtctctagcttctcctctataaaagcttagatgcagatgaaggtcatttgaagctgataacagatgactcagcacaacacgaagaggcccaggcttgcgaatgaatgagtaagtgaacctgaatccctgaacacttgaggtagccacattttcacacagccttttaaaaactagtcagaaacattctggtggccgagagacagaaccttatttggggacattgtaagggttagacctcagctgatccctaaaacttaatgtttctcagacttatgaaagaaaagaagaacctggaagaaataacgctctttgcaaaatactatgttctgccaaataccttaaaatatcagcatagtgaatttcatcatgtgaagcaggaacaattttactaggagaaaaactctgtatgtagaactgggagcccacatgtccacaaagaaacaagctgtcaaaccaagcatgatcaactgtttcagaatttttccattaatattcatttgctgcttgttcatttctttggtcgtctgctagtgcttgctaccagacaagtggtagcaggcatcaaagtcaaagaataaattttgggataaaacattgagaaaattatctcctctaatatgacaatgtttttctccctgcaaattttgaaaggattgccactacccttgactaatactagccatctcagcccaatattccactgggcagttttataaggtaacgaatttggatcaaacctggaagagtattaaaatatggccaggtgcagtggctcacgcctgtaatcgcagcactttgggaggccgaggtggtcggatcatgaggtcaagagatcaagaccatcctggcccacatggtgaaacccgtctctactaaaaatacaaaaattagctgggcgtggtggtgcacacctgtagtcccagctgctggggaggctgaggctggagaatcacttaaacccaggaggcagaggttgcactgagctgagatcatgccactgcactccagcctgacaacagacaaaattctgtctcaaaaaaaaaaaaaaaaaagaaagaaagaaagaaagaaaaaagaaaaaaagagtattaaaatattggcctaacaacattttaaaagataaagtaggccaggcatggtgactcacatgtgtaatcccagcactttgggaggctgaggcaggtggatcacaaggtcaggagatagagaccatcctggctaacacggtgaaaccccgtctctactaaaaatacaaaaaattagccgggcgtggtggcgggcgcctgtagtcccaactactcaggaggctgaggcaggagaatggagtgaacctgggaggcggagcttgcagtgagccgaggttgtgccactgcactccagcctgggtgacagagcgagactccgcctcaaaaaaaaaaaaaaaaaaaaaagataaagtaaatggtaataacttgatacccaataacctattcctactggaaacaaaccttaaagatgggaatctctaaaaatttttccaaacctgagattctttgaactgcacatctctaaaagttctttgccagaattttcttctgagtggctcaaaatcatggaaattttgcagaacttttcaacactatgttagaaatccaatgcaggaagtaaaaagggtcttctactggaaaaacaaaaaaaaaagtatagacattaaagctgaaagagtggctgggtgtggtggctcacgcctgtaatcccagcactttgggaggccgaggcgggcagatcacctgaggtcaggagtagagtattttcagtagagactaaaaataccaaaaattatccgggcatggtggtgtgtgcctgtaatcccagctacttgggaagctgaggcaggagaatctcttgaacccgggaggcagaggttgcagtgagttcagatcacgccactgcactccagcctggttgatagagcaagattctgtctgaaaaaaaacaaaaaaaaaaacaaaaaaaaaaacaaaaaaaaacgctgcaagactttgagtacatttgtggtgtgcacatgtacatgcatgcgcaagtgggtactaactaacatttttagcagttcaagggcatagtccagagttttgacgctgaagtatcatgtatgggcattaagagagaaatgaggtagaccccttctcctaaacctggaaaacaaagaatgggaccttgactcttcccagatgaatatcaaatatatttattttaaaatgtgtgtgatggactgtcttgctgtaactaaaaccggatgatgagaaaggacatcatgcagcctcataaaggaaactgtccagaaggcgggactctggattgtgtaacctggatcccacagcagggtcaaggtcagtggaattataaacaggctatacactaaaacttgaccgggccagcctggttcagtggatgacttctcattacccttagaataaaatctaagctccttactatggtttgtaagtcctaaaggactgggcctctgcccacctagtactctccttcctgttcaccaagttccaaccacactggcattcttatgttggctcaaatatacttaacttattccaacctcaggggctttacacctgctatttcctcaattcttcacttgcacacatcttttgaaacagaggtctttcctaaccaccctacctaaaagaacttccatcatcccaacccagccatggtctttcccatttccctcctttatgttcttcataggacatgctatcatctgaaatgaaaatataggcatactttttcaactacctctcctgctagaacataaaggccacgaaaatgaggatcttatctttcttaaccacaacaggaatgagttgaaagagttgtaccaccaagagagataactcttagagcacattctctactgtgtgttaatttattttttttgtcattcaaaaagcacttattaagcacctaccctatgccaggcaccattctaggtgctcaggataaagcaatgaacaaagtccctgtcctcctggagcttacattctagtatgcagagatagtcaataaacaaatataacaatatcaagtatgcttatgaagaaaaagaaagctggatgcaaaaaaatgatacataattggtatttcatgttttattatatatggggtattctgtaaaggcttctctgaggaagtgacacttaagtagagagctaaaagaagtgaagaagctaccatgtgagatcagataagagtaaatgttaccccacacagaggaaataggaagtgcaaaggccctgaggtgggtgtacggttggcaggctcagagaacagcaaggaggccagggtggctgaagtagagagcatgaaggggacagggatagaaaatgatgctggttcaagtgcaatgtctcatgtctgtaatcccaggattttgagaggccaaggcgggtggatcggttgagctcatgagtttgataccagcctgggtgacatggcaaaaccccatctctacaaaaaaaaaaaaaaaaaaaaaaaattacaaaaattagccaggtgtggtagcccacacctgtagtcccaactacttgaggagctgacgtgagaggactgtttgagcctgagagttagaggctgcagtgagctgtgtcacactactgcaatccagcctgggaaagaaagaaaataaagaaagacaaagaaagagaaagaaagaaagacagaaagacagaaaagacagaaagacagaaaagacagaaagaaaagaaagaaagaacgaaagaaagaaagaaagaaagaaagggaaaagaagaaggaaagaaagggacaagggagaaacaaaggaaaggaaagggaggaaggaagaaaggaaggaaggaaggaaagaaaagaaagagaaagaaaggaagaaagagaagtgtctgttcatatccttaacccacttgttgacgggattgtttgtttttttcttgtaagtttgttggagttcattgtagattctggatattagccctttgtcagatgagtagattgcaaaacttttctcccattctataggttgcctgttcactctgatggtagtttcttttgctgtgcagaagctctttagtttaattagatcccgtttgtcaattttggcttttgttgccattgcttttggtgttttagacatgaagtccttgcccatgcctgtgtcttgaatggtattgcctaggttttcttctagggtttttatggttttaggtctaacttgtaagtctttaatccaccttgaattaatttttgtataaggtgtaaggaagggatccagtttcagctttctacatacggctagccagttttcccagcaccatttattaagtagggaatcctttccccatttcttctttttgtcaggtttgtcaaagatcagatagttgtagatatgtggcattatttctgagggctctgttctgttccattggtctatatctctgttttggtaccagtaaagaagacatttatgcagccaaaagacacatgaaaaaacgctcaccatcactggccatcagagaaatgcaaatcaaaaccacaatgagataccatctcataccaattagaatagcgatcattaaaaagtcaggaaacaacaggtgctggagaggatgtggagaaataggaacagttttacactgttggtgggacggtaaactagttcaaccattgtggaagtcagtgtgctgattcctcagggatccaggactagaaataccatttgacccagccatcccattactgggtatatacccaaaggattataaatcatgctgctataaagacacatgcacacgtatgtttattgctgcactattcacaatagcaaagacttggaaccaacccaaatgtccaacaatgatagactggattaagaaaatgtggcacatatacaccatggaatactacacagctataaaaaatgatgagctcatgtcctttgtagggacatgaatgaagctggaaaccatcattctcagcaaactatcgcaaggacaaaaaaccaaacaccgcatgttctcactcataggtgggaattgaacaatgagaacagatggacacaggaaggggaacatcacacaccagggcctgttgtggggtagggggaggagggagggatagcattaggagatatacctaatgttaactgacgagtcaatgggtgcagcataccagcatggcacatgtatacatatgcaacaaacctgcacgttgtgcacatgtaccctaaaacttcaagtataattaaaaaaaaaaaaaaaagaaagaaagggagatgttggaggtgcaatagggtcagatgcagagagaagcctgagggagaggtggggttaagtgtatttgagcaaccataagaaaggtactgtggctggagcttagcaaccaggaaggacagcactaggaacctgggctgatgggcagaggcccagtcatttaggacttacagaccatagtaaggagcttaggtttttaatgtaatgttataagaatggaggcttacactgaggtcttcagagaatcaagcaaggcactgcgaaagcaggagcttgaggtctggccaatctcaatctctttgagactttcaaggttccagcatgaatcttatcagacaccattacttaatcagatgcccctttgagggctgcatcaggcttttaattctcctggaggaggcagcaaatgagcaaagaggaggacacctctgtactagcattgcaatcctgaggactgcagtgaaatttagggaagaaaacagatggaggtcagagcctctgtgacccagctatcaaagaaaccatgggcctattttggccttatttaagtactctccgattactgggaactgttatttgtgaaatacatgtataaatgggtttgcatgttcacttgtacatcacagatattctctgatatctgagtagggacaaacttaagagtccacatcaaagccttcatttgacattgaggaagctaaagcccagagaactgaagtgtttgccacagtatgaacaactgtttcagagtctagcctgcctttgtcttctcccatgtcttctcctttgttttccctgacactgccttctgtttaacacatataatccatatagtttaggcccatggcatgcccgtctaaggaaaagagcgtcaattaagcaggagaaaaaactgaattgctgttttaggcatgaagtcttaagaggggactgactgtaataagctagtgttttcttcttgccctataccacactgttacttccttccacacttcgtggctcttcaggaacttgcagattacaccgaatcccagagaatggagatcccattagtaggaaaagaagggttgaatatttgcttgaatttttctctcccaaatgtacccttcaaagcagagttccgccagtcaggcccaaataatcttactctgtggctgaagggtgccccgtgggagtgtctgtgtgtacacagtggctggcaaacatctgattttttcacttagcatcactctacctgctttgaccattttcataagaccaagcctggacaaggtgactggcctaagccacatgactatgtttgtctccctgctctcacaaatgctcagtcgacttaaaactggctatcttcaaagatatgcttgaaacagaggcgttgctacttgaagattactaacatcactccctttcctcatataccctttaaccatcattaagcttcagtgttcttccctcttcattgttccaccttctccatcgtatctcctcccattgtttccttggtcattcatttatcagaaactcccaactctttagcaacagtttggaactctctcctaacttccaaaccaatgcctaagtcttacagggagcacattctgcccatttccttccctatctgcccccctaccaccaccaatttttccagaaaatcattcctcttcctcctatatttagttagaaaactgcactactatagatacagtctcccaagctgcaaatgtttctcgcgtagcaagttagtcactgtatcttttcaattctctcacatctgcccttgcctccaccactactgcccctgaccttcagtcatctcctgcacagactttaacaatgcagtcctaatcattctctttaccccttgtaaacctacctgcaagaggcaataactcaccattattgactgacttcaaatgaatgtgacaccgcccgcctcggaaggaaattcccaaacaggaatccaacaaagcttgaacataaacatgggttgtggaatagcacctgccacagtttcttctttgaagaagatgatagttgaatgtacaagtgtaggtaagtctgtcacaaagaaaatcaacctcatcacatttcaggcacatgctcaatggaagggaaggagtgtcggtagactttagattttaagagatctttgggggactccctagttagatggctttcaagacacatggcctctcctagcttccatcttcccatctggaaattcagatattaatagtgctcacttggcaggactgttatattatgtgataatgtgtgcaacgcaaatctctctctgcctgatgcaaagtaaatggcatgagatgccttttttcccccccttagcacctcctggttacttctccctttatccaagctcctgcttctccacagcaatattgtacctgagcagaggattctggatgatctcaccaatgtgctaaccgtgagggcgatttaaggtgagcagccttttcttctgagtctcttgcctgggtgttgggcaaatgcttccaccggctggctgacatatgtggcctgctgcagactaatttcttgtgacatgttgccttgaatgcacagtcacagagcatgtgctgaagtgctaaacacccccaaactgtgcactttccaatctgtgaaagctttttggtgggtccaggctttttttctagacctgaggcattataatgaggaagcacatggacacgtcattgaggcaatctgtcaccttgcaaatgcttaatagcagcagcaggacctgtgtgtccctctcagtgagccagacaccaccacacagctgctcttctgttgaagttgttgctgcattaatgagcttccagacaaaggcatgactgtgtggtgtgtagctcagggtccgcacgcaggctgggagtaatgcacagagggagacctatgctcaaaaataatacttcatttgcaaaaaactggtttggagcccacaggaattactgtgtttctttagacttcaaaacttgtaaaggccggatcatcctcctgcaatattttacgataacagtagcatgttaacagttatctgatcctctagggtttatagtgttttcacactttgaacctcaccatatcactgtaaacgtattgttttacggatgagaaaatttgagtccttcaaaggttcaacaaaatacacaagttcatgtggttaataaaaggcagggacagcccttgaatggagacctgtatgactccaggtgcttgactttctgaagaattatcaccagacttactctcagttcccccatatgtactaagatgtcactgaaacagctaaaaaggaagcttctgatagaaggagctttcaagggactgaacttctccattaagattttaagtcctttatctgccagcatgttaaaggagactagggcatcccagacatttttcaaaagctaagccttacacccaaagcaggtccttcctctgccttgcttatgatgatgatgtaggaaccttatgtgatacctcacaccaccaatataggagagtaacaactgaaacagaaccaagaatatagaacagatgtagaaatcaaaccccaaactacctctactacttctacgactactattaataaaataataatgcagataaaacagcaataacaaaaataacagtagtcagcatttctttagcctctaccatataacacttactgtttgcatacattatcttgaattctcccaacaatcatcaaataggggttgtcgtccctctgcagatgaggacactgtggttcagagtggtaaaggaacttgctggaggccacagagtttgtacatggcagaatgaggcaagatgctcaggtgtcccgactccaaggctgtgctatttccattgggccatacttgccttctctcaaggagatagataatcaccaaactagtgagtagtgttcaggaggttaggaatccccataacccagtgtggccaaggctgacaaagcctaataggtgcatagctgctccttctgatcatccaaggctaacagttatccttcaggacccagaaaatgggtttcaataacctgcttttaattttctgtgcctggccaagaaataatgaacaaagggacaacttctaaaaaaaatctggcttcaggtgtgagttcaatcaaatcctctgacagtgtgttaaagtatctgtgtatgtgcacacacacccacattcatgccacacaggtgtaggatgcgagcagagaacagtaggctgattccatgtccttttctgcctcctgacagctatgaaactacaagtgggtagattatagttgaagataaaaatagacattatactgccgctttctcttcccagctttttagtcgctccagcttgaaagcatattgtagcattttattgtagtctaggctcttgtggcttctcttgtttgccattcctttttggaaaactagaaacattccctctccatggggaaatgaactcaagtaagtgagagagaggcggcagagtgcgcacatgtgtgtctgtgtgtgcctgcttgtgtgcacgctcatgtccttccacgcctgagggaggaaaggaggtggaatgagtgcatgtgtgtgcctgtgtcccactgcctctaagagaggagaggaggcagagtgtgaatctgaatagagcggaaattggaaattgacacagctgtttttgtttcactgtaaccatttttagaacctcaggatgcactaagcttccaaaggaggcagcccactcagccttgggattcaacactagccaagagtgagtagtgatttgaaggcactggatgcatcatcccaaggtctacagtagacccctcatccaagcattgcaggtcacttggtataatgcatattcggtgccctctttgtgtggcagttaaactgaattgtgcaagtagttgcacgtcaggtctcatcccaaaccctctcctttccgcttatcatctccattctttctcccgaaattttcttttaggggcacaatgttccatgtttcacgcttaggttccctggacaacagcaccgccagtcagtgtagctatgttttataatacacatttctgtgcccactgcagatctactgaatttgattctatcaagaatttgaattttaacagcctactcctggttattagtgtcataagcactaaatttttcaaatgcctaataaagcagcaataaaatcaagacttcggagttgcacttgcctggtatcaaccactgaaatattcagcctctcatcaccttcactagttctaccactttatacccaggaaaaaatgagagccatttacaagctttgtgaccctcatcaactcccaatttctctgggtttcatttcttcatcttcaaaatggggatgataatggcacctagtgtatagggttgttgtgagaattatatgagaaaacatatgttaacacagggcagtagtgatcaactgggagtggggtgatgttgcccatcaggagacaactgactatctggagatatttttggttgtcatataggagtaggggtgctactacgatgtagaatagaagccagggatacggctagacatcctataatacacaaagaagccctccacaataaggaattaccagcccagcatatcaatccttaacattttgagaaatccagatgcgaagttcagcacatcaggactgggttcgaattttagatgccaccaatctggctgtgtgatcttgggtagattgcttagccatttggagcttcaatttctccatctgtaaaacagggataaaaaatcctgtctcacaaggttagtaagagttcaaagaagtaatttataaaatatgtttggcatattttcagtagggtcctttcttttagttcctcttaaaagaggctggtttccacattcctaatgacctaggaagcctaaggcttccttacctttaattcgcaagtgaggtactttatgtgttggctcaaggcagggcacagatggcccatcatctgagcatgcatgcatggccaggccctgttactgaggttaggaatcatagggccccctattgggccatggctctaggacagccccatagacagccacaggctgacatgcttaccctgaatgcactattaaccccatgatcctatttttatataatgaaagaaccaacttattttgtaaaaagagcataaagcctaaaaataaatctagctaacaaggtgaggtttaccatctagagagaagagaaacattacaccctttaacatttaggccattggatataggatcccccaaaattaccatcagctacttatttatccacttaaatgagagagagcagaggtgtagataaatcaatgctgttttagattttatttgtgacctcaaagagcacataaaatctaaaacattgcattgatttgtctatatcttgatgcaaaaagcatcaaggatatgcaagatcttggtgtacccttccaaacatgctgttgtttctggatgtctcatcccaggtactctcatgttaaacttggcactgctgtcagtggagtaggagaggcttggaatttcactactctgggggcaacctgaacctatgaaaatcacaaacatacagcagtaaaattaacttgcactaggagagagatgtggagacctccccataacctcacttctctccaagtcccaaggccacccaagtcatcttcattcccctactttctagcacaatcaattccaacatcctttgtcaattgaacgctcattttttttttttttttgtccacctagtgtactcaaagtacaaaatgactaagggcatggttcaagccctcaaggaatagtaaaggcagaggaaacaagatccccactgcccccaaaattaagggctgctgtgccctaagaaagaaaagatgcaaatcagaatcagggttcttaatatttgtgttttgagcccagtgacacacctccctcctgggaaggggagagaagggagttgcgtgagtggctctgctataggatttttgctccggatagagatggaaacaagcaaacactacacaactgctgccacagcatggagcctgtgatgaagtcagcaggcaggtgccgcctcactctccctcatccccctcatcgttatcacacacagctgcatcagcttttacttttcattccggtcaaatacactgtaaattcatcctgctcatcaggaagtctcctgttaaggaaatgagactctgacgcgatcccagcagagtgccaagaccagagaagctcagacccccagtggctctctgcctgagggagacttagccacacaaatggaaggctgcttttgtctttctgggatggtggaggggggagcaatgctgccttccagggctacccctagcgtgggtctcagaatcttgagaataaaggaccctgcctacgttttctctgtactgtcagctttgcccaggaaaaaaatgtgctctccatctaccctgggtcgggacaaaatgcaatgttgtgtaatcctatggcagcccttgaagtatgtaggtagtatcttcattttatagtggaaaagaaaatgattctcagagaacagagaagggcctctttccccaaggaggcctcctcagctataaaattcactttacattgaaatatgtgcaagtggttaagaaagaatctgatcttgttactcctttgcttaaaaccctccaaaagcttccccattgcctgaggcagtacttctcaaccctggctgcacactggaattacctggggaaatttaaaaaatgccaatgttctggccccaacccagaccaattaaaccagaatctatgggggtggaactcaggcttggcactggtgttttttgaaagctgctgagcaattctcaagtgctgtcaagattaagaaccactgccctaagggattagtgtcaggctcctcaacatctcttgccgaatcctctgcagccaggcccttgcttatttctgtggccctatcactcaccactctctcctactccctccttagccattcttcatccctcctctgccagcttgagcttctccagaggagttacacactcacgcctctttgctttgatgctctaccatcgatctccctaaaatgccactccctctcttcacctaactcctacttgttctttcagatggagctcagcactgctgcctccaggaagccttccctgacaccctctagtgatcctcctaggtgctctatatgagcatacctctagcactcccatacattgcagctgattttcacttatcttctccctccctggaatgagtgccttgaccagaacagatcctatgcttctgctcattctcagtacacagcaccagggcactcaaaaagtttgttgatccaaaagaatcgagagtagggactcacacacacactcatccttgtacaccaatgttcacagtggcattattcacaattgccagaagtgggaaacaacccaagtgtgcatcacagatgaacggataagcaaaatgtggcatataatacatacaatgggatattattcagcctttaaaaagaaggaaattctgacacatgtgcaacatggatggaccttggaaatgttatactaagttaaataagcttgacacacaaggataaatattgtacatgtatgtgagatgcctaaaataggcaaatttatagagacagaaattagattaggggttaccaggagacaggggcgtgaaggggaaggggtaatgggagctgtttagtaggtacagagtttctgtttgagatgatgaaaaagttctcaaaatgggtaatggtgatggttgcacaacattgtcaatgtacttaatgccactaaattatacacttaaaaatagctaaaatagtaacttttatgttatgtgcattttaccacaattttaaaaagaaaaaaattgctgaataaataaatcacattgtacttagaagagcaactaaagccttactcacagccccttacaccatgtgatgtggctcctgctgtcctctctgatctcatctcctacccttttcccataaacattctactctgaccacattgcactcttgttttttctgcaaaaataccagacttgttctctcaagttcattgcaatagctttccagtgcttaaaatgatcttcttctacatcttcatatggcttcctccctccctcttaattatgtatccttcctcagaaggacatgaccactccatttcaaactgctaacttcactcctgccatccaaattactctgtgtattggttaagctaatgcttgctgatgtcatgaacaaactctagaatctcagtgacttaaaacagtcctaaactttcgggtgcatccggatcattttgaggactttttaaaacacagtttgccagaccccacccctccaagattcagtatatctagggtggggcccatgaatatccatttgtggcaagttcccaggtgctatggcttgaatgtttttgtcacctccagttaaaacaatccccactgcaacagtgttgtattagtccattttcatgctgctgataaagacatactggaggctgggcaatttacaaaagaaagaggtttattgaacttacagttccatgtggctggagagacctcacaatcatggtggaaggtgaaaagcacgtctcacatggtggcagacaagccaagagagactgtgcagggaaactcctgtttttaaaaccatcagatctcatgagacttattcactatcacgaggacaatgcaggaaagacccactcccataattcaaccaccttccaccgggttcttcccacaacacatgggaattgtgggagttacgattcaagatgagatttgggtggagacacagccaaaccatatcaagtattagtaggtggagtctttactttaggaggtgaataggccatgagggctccactctcattaatgagattagtgaccttatagaaggaccagccggaactagctagactccttttccccttttgtcccttttaccatgtggggacacagtgttcaaagtgccatcttagaagcagaaaacagccttcactagataccaaatctgctttgctctgatcttggacttcccagtccccagaactatgagaaatacatttctattatttataaattacccagtcttaggtattttgtcatagcatcacaaacagactaaaaccccaggtgatgctgatgctgctagtctagggacccaattttgagaaccactggtttaacacagtttatttctcactcacatgaccattctatatgggcactttgagctgataagtattcctccatccagtgattcaaggatcctgtggctccacttcttttaacacagtgcccacagttgtcccaggagtggtctccctccaagtcaaccaaaatagaaaaaagcatgaaggaccatacattaaaaattgttatggtccatgcctgcaagtggcatgtcacttcttttcacattttattggccagaactcagtcaaatgaccacactgaactgcaagggaagttgacaaatacactctatctttgtgtccatgtgaaagagtaaatgggattggtaatctactatacctaccagcccctcatgctattatatttgtctccataataaggcctatctctacctgatatgaaatcacatatttatttgcttaccttttaattgcctctcttcatgagagtgtaagctacacaagggcagagaccctctcttattcatcactgtattttcagtacctagtacagtgcttggaactgtgaacacataagacaccaataactatttcttgaattattaaatgcatttttgtggggcacactctctgatgacgtcatatttacctcttctttcagatgctctggaaaccatattctttatcctgcttatgtcactgagccgctgccatcagagtaggcccgtgtttacttaagccaacatatgggacaagtttttctaatagcagtaacaaacttatgttgccctcacaactgctctgtcctgagcatagcggtcatggtgtcttatcattcccaatgtctctttctagttcaccctagcggccttcttcgtaagtgacaagaagagcccccaagttcattcccagccaggctgaggactcatgagctggtctagcataaagcaaactctaaatggactgatggtaactaagacagataactatcctgtgggatttgaattagagcagtttggaaattaatcagcaaaacataaaagagtaaatacacagaaagaagtagacacactctgactgtgaagtagtgacagtcaagagagatgaagcaactgccttggatcctcatagccttcctgtttcaaatgtagtaaattgcaggatgtctttaaaataaaccccatttatgaaggggtctaaatgagtaactgctcctcatttggttatgggcctgactaagctgaatcagtacctgttgacaagatagccaacagtttagtaagggggctcagtgaggggttagcacattcatatgccacttaaatgtcatatgaatgccagtttaacaaaatgaactgctccacccagagatggtatctaggtctacatactccatccaggatattagttgctccctgccctcattaccttatactaaggataacacagcagtttcttcactaccttcctcatctcttctgcaccttttcatcagattcatctctcataaatcacgacttttgctccaacactcccctgctctgaaccctccatgttttcccacagatcacagaactaacatttaatttacatttgtgtgataagaattcttccagggctgcatatacattgtctcacttaatcctcagaccaaccctagaattaggaccaccatctttattttgcagctatagtgattggatcatgaaaggaatgaataaattgcccacaaacatggagctaggaaccagcagagccaaagtagaaacccacgtgtgcctgtttctaaagcttctcctatttacaaatagtatgcattctttcattcattcagatattggctgagtgtcaaccatgtgctgggaattatgctagataccaggattacaataatttactgatagataaagtatcattagtattagacagggagtctgaatgctaaggaagcaaactgagggaactctttcaagcctagcttcattgctcagggaagcccttctcaaggcagtgtcattgaagttatctgaaggtcgaataggagtgagcaacctgctttctatcaggaacataatcctggtagtaaagagacagcataatgcctttctctctctgactctcatagactgctgggcagggaagagggaggctgggggaagaagggatgaagggaaaaacccgaaaagacctattaattgtcaaatgatatcaccaaagcatattttgtatttcaacgattcctatcctttgggtttccaattgttcctgtgtaattttaaactaaaatctatttccttacccagcagcatctctttcttcttccatacagagatgcaatttcattgctagtctgttggcagtgctaattatattctccctagcacattcctgatggcatggaattaaataaggcaggtgtggaggtgacagaacaaaacaaaatatatgacttatatgacagactgattggtctggtggaggacaaggtaaaaacagcaaatgttattctatataaagattagggcaaaaggcacaatagagtcacacttttatacagataaatcacaccaaattgaaaataatttttagcagtttcctctattataaatgtagtctgaacacactgtcttactgttttcagcctttcacaagcttctgatttaccttctatttaagatgtctccaaattaacagagagaactattttgatagaatattcaattttgcatttacaacttgaaggttgattcacaatcatcacttcaacatcagagtgaaagtagaaattataaacatctttataagagctttaccaaatggggacaaaaatggaaaataaattctggataagaggcagaaatagaaaatctgggcaaataagtcagactgtacatccaaactggattagataagtttcgtaagcgataaaatatttgtgggaatgggatgtccccaaatcagaaagcctgacttgtggttttgctgatgcctcccataaaagagaaactataatttcagtcatatgcatatatactatagttgtgtgttcaccaaatcccatttccttttctccctgggttcatcttctgtgcccatattcccagcctcccctagatgaggtgtggcctcgagactgagttccatccaatgaaacgtgaatggaagacctaggggagcctggaaccatgaatgaataagcagagcacagccatcccacccctccacacacatctgccctgacccacattagaccgcaatggaagggagcaaatgccttaagtgactgagcttccagtgttgttttttttgtccagtagctgaccaaccataagtcaaccaaaggcatgaccaaccaaaggcagaaatgacacagggcccaccatagtagaccacaatgttgtaggccatgagttaacctacagatgaacgagttaactgcagatgttctaaatggttctactggatatcgatggttgaaaaactttatattaagatataacaaggtttttgaataaatttccaaaggccagagcatataagaggaaccaagttataaaggaggagtggacagaaggaaagatgagtaagggggtaatgcaactggtacctaagatgccgcttccaaatttgtgagcccctgaaagaggtaatcaggttcctctttgtctaaatgcctcatgtatgcaccagcgactaaagtccaaaacctctaaagttggcactaaacactttccataatctcatccctgcccagctctttaacccatttatgctggaggttgcaaatttttgtgtgtgaaaaatcagaccttggcaatgaccttgagcagtagggaggatataaataactcccacaagcttagcattccaatgatggaacactaggcataaatttaatcttcaactactatctatcctctgcttgacccaccctgtattgcatgtgtttccttaacaactcccaccttatgcctttatgtgtaacattccctttgtaaggtgtacccttcccccacctcatttactttcataattcataatcatctttccaagctgagcttaaaccacatctgctgatacctattcttcctaggaaacatgctccttaagctgggttcccataacctttttttctttttttttttttttagacagagtttcgctcttgtcactcaggttgaagtgcagtggtgtgatctcagctcactgcaatctctgcctcccggattcaagcgattctcctgcctcagcctcccgagtagctgggattacaggcattcaccaccatgcctggctaattttgtatttttcgtagagacgcggtttcaccacgttcagcaggctggtctcgaactcctgacctcaagtgatccacctgccttggcctcccaaagtgctgggattacaggcatgagccactggatcggcctcccataaccctttataaccacatgtatcacagcacttatgaaagtcatcattgttgctcttcattctcatccttggctagatgggtatgtccttgatgacaagaatgacgtgtgatggctctttcctcccgttggcctgttgagtatcttgccccttgctccccccaccccaccacagtaacaaacaataagtgtgtgattgagttgaaaacgaggcacttcctggggtgtacagtccagatgtgactagagacagtggaatgctgtgaagattttccaggaaacctaggaaatatgccagcaaaagaagtccactgcagctcttgaataagttttgctttacagattgtcagtcagtcagtcagtcttgaggtgaaattacacttttctgtaagtacagatgtcaaaggaaagcaagcttaggaacgtatacattctctaaagatggcttagaatgtatacaaataaaaagtgaacatgacaacctgagaaataaaaataaatctagatcaaatgacttcttgattccaaaggccaccccttcctgacttcacacattaaaaatattcattttcccgttaaagtgtgtttttattccactgttaaaatgcaagtaccagaaatatcctacatgtacaataggggcatggttaattacatcatggactatccaaaggaagaaattgtaatggcatagaaaaatgttcacttccaattttgactaaaaggaccataaaaactctattgaaagtatgaactcaacaatatattcattttaaaatatattcatatatatattttgagacagagtctcactctgccacctaggctggagtgcagtggggcaatcttggctcactgcaacctttgcctcacgggttcaagcgattctcctgcctcagcctcccgagtagctggggctacaggtgcgcaccaccatgcccagataatttttgtatttttattagagacagggtttcactatgttggccaggctggtctcaaactcctgacctcgtgatctgcccgccttggcctcccaaagtgctgggattacaggtgtgagccaccacatccggccgctatttatatttttaaaaaggaaagaactgcaacaaactgctgtaattgtggttttataagagcagtagcgtggatggctttattttcttccatatgcttttgcatatttttcaggttttctatgataaaggcagaatatttttataattagaaaatgcaaggatgctctcttttgaatcctattcccacttctttataactgtgaccttcatgcaagtactacacttctctactgcttcagctttctcatctggaaatggagatgatggttctttttagggtttttataagataatcatgaggtagtccacatgaaacacttagaacagtggatggcatacagcaaaccttgataaatgttacccaaagttgttgcatgtggaagagcccagcgggggttcagaaactgaagcagcgaggtcagatggggagaggataggctcaaatagcaaacctttgtcccctacggttttactcaagactgctcagggattcaaacctggcaaattattggttccctgtcatgcaatgctcagtatctcctttgctcaacacagctgccagagaggaaggaagaaaagatcaattttcaactttattctccattgtctttctactttctcaccgcaccctccctttcatttgtattttgtcttaactgccaattttgggcttaattggtagaaggcaaagaagctcaagtaaaacaaagctcagcagaatataaagagaaaaaggactaaaaaaatgaaggcatgaatggctgtctcaattctatataatctgagaagcaggttgacatggcactgaaacatatatgacctcctattgaagtgggctaatgtttcatttactgctccaattttctcatggcagagataatttacctgtgtgatgattacatagtgcctccagtgtctcaggaacttttgcctactgttgtatcttgaatttgggaaatctgtctgctttcaaagtactgaagataacttgagaggcaaggcaatctcatttcccgtccaacacaattgcagacttgggttcaatctattaaagtcaattggtagatttgcacaagtagtctaattagagatattcagatagcaggcacaggttccgtttgcattctaggatttttaaaaaaatcaatgtccatgcacaggaagaaaactgaacacttattttaaagccacagattacagcagtgccatgtacagaaaaccagtagaggggctataggtcaatacaaaaatactaccgcatggggaagaatgattagaagggacgggcagagttttcacctccaggtcacaagttcaaaatgctgcccagccctgcctgtatgatgtttataacccactgacagtccatgtaaaaagggccggctcagagactatcttttcaccagaaatgtcgtcctttcagggaagagactgagaaacaataggaaccccgcaaatgaactcacctatgcagctcctcgaggtgtattccacctggcacagccatgtcaattgcccattgactaaagcccatttccggcgttctcgacccaggctctgtggctgtgggccctgggaagttgaggcttccagggggacactcagttaacatctcttaccttacatcctgactttcagccacagagtcagaaagaaggaaggcaaaacataaaagtacttccaaatgtccaaataaatctccttcctccaggttcctggggctcaagttcttctgagatactgaatcaaactagcaactaaaaactgtagatgaaagattctctaaaatttagcctttgtttaaacagaaaacgagtattcattaaaccataaccatgtgacaccactctatgaattgctttcctagacttccttcatttcacaaacatttaatggagagttgctaagccaaaaagcaaattaaaaaaaaattaggatatatggatgagggaatatattccctgttgcaagagagtctgcaggagtcttcaattcttaagcctgtgaggcaatttttacctcgcattcccaaaagtattttaggcaactgagagttagttggcatcatcatcacactgttatcataatcattcccattgcatagagttgagaactgaggctaaaagaattggagtaattgcccaagatcacacatctacaaagtagcacagcccataaggcaacatagactatccagtcactggtttctgcttacaacatgccaccttttattataattcagaaattctttctccctagtccaggtttacccaaaagcttggcaagatcaaaaggagacaacagaatacttgatactattctaaaatctcaaggaaaagaaaaaataaattttctttgagtatgacaacacaaacctttggaattagtcagtgctacctctaggggctgcaagtcctcctgccctaagagttttcatgttggattaaaaataattagtagcattccacactgtgcaaagcagaatcagaacactgcaatcctcaccatgtgggtggccaagaagaaatatccttccctttcagagaaagtccaaggtagagaagctgtatggcagggtggagagggaacagcatctgtatgaaacccacctgagtgtgaatcctcaatctacacctggtaattctataactcggggcatattaatgttagtgtccacatctgtagaaaagtggtgataaatcccattttgcaggattgttgacaagatgcttgtaaagcaccgagaagcatcctaggacatggtaagaactcaataattggatgctattatttttgttcctggtcctcctaagcccctggaaattgatatgcagtggaagcagtttcatggcacgttccatggaattctctattctgactgcctgagaacagcatgctgatctcctcttgaggtacacacaccctcttgcatctgagcagtcactcactatacatctctagggccacccataaaagctaaaaaaaaccctcagaagtcaccaagaagttgtgctttatagagtgcaattctctgacccaaatcagtctttgcctttgaatcagtttatgctactagttatttagtagattgattgctgctatggcaactgcacatccctctgcacagacacaggcataagtccttgatacaatcctggcttagtttctctggctgcattcagtacatgccaaaaattacataatattgggaaaattaatttctttctgcactgtaggcactggggctgcattgtggtgcaaagaacaaatgaagcctggtgtataaagcgagggctgtgcttctcgtccaccagcttggaaggagagagaactgaagagtccccagctgctttttggccacactgctcaccttcggtttccacggtttctgccaaatatcaaggcaggatgtgcccagagactgcaaacgccacttggcagtgattaggagtctttcaggaaagctttccactaaggtaggaaagtacaggtttttcttacattagaaagagttgggtaaggattctgagcctaccacttccttagctgcatgatcttgggcaaatcccttaaactctgaaacctcagttttcccatctacaacatggagaactaagaatagcatctgctccccttggttgttatgaagataatatgacacaacaaccctggcatgtagacagactctgataactggcaggtccatctttctttatcttccctttaaaaaaaattttttttttggttcttttcttctgattagtaagagatattattaggctcattgattaaggagctggttctatgctgtccttaaatatttctaatttacaggcttgaacttcaatcaaattctgctaagtgtgtcaagtttgctgtagaatatagatcagtgtttttggctggtttcagcccaagaagacaggctagatcccataagtgagttttgctctgttcgattctgtcacctcagccctccccccttttcccccagcttcaacttccttaaaatggcagttatttattatgaaggaggatggaaaactagtgtgtaagtaaaaaaactgcacccacttctcgaagagtccctcacctctcatattctgagagaggctaagcactgtgatcattgtttgctgaggaagccatgttattagcagccatgctatttctgtatctggagacgccaggaacacttacagaaatgcttctaaaccatatgttgtttttatattttaactactctttatgtctatataatttgcataaatacaaaaataaatagctgtcctgcatttctctgaagattgtaaactccaaagaaagagggaaaaattttcccatgtatcagccttaatggcagaggacttggtattcagtgaaagtcagcaagaccaaactgactttctgggatttcatagttaatcatttatgacgcagatagtctccttgtatgtactttctaccatcaaggttgagaaagcatggcatgatcagacataagaccagaaatatcattacaccataaaccaataccaatttcatcaagttattctgaagatcacaggattcaaggtcagttacctgggataaaacaatttatatgaagaaatgctttggccacaaattataacaaacgagaacatggctctaaaaccagagaggcctgggttctggatttaaccctgtctaattctcaatctcatcttctttaaaagtaatatttagttacttgcagggttgtacaaagtgatggttaggagtgcaaactgtgcagttaagaatgtctaggttggattcatggcctgtccacttagtgttcagtgaacctgatcaaacgactttacctctggaagcctgtttcttcctctgaagaagagaggtagtcatggccctattgcatgggttgttgtgaagatgaactcctattatctacgtaaagtgcttagcacagggactggcatgtaagcgctcaacaaatgtagccagtggcggttgtagagtagtagcaaatgaaatgatgggtataaaaaacctggcttttagtagattttttagaaaatggaaacgtgtgctgtcaagaaaattccagaccattgcaaatttctttggaatcaaaaagttggacagggactgactatgatgagaaaggaatcctcttataaatcggtcctccattgaagtggcttcagtgctagcagaacagtaagggggtagtgaagtctggcctgtatgcagcctccctagttctgaagcgatgcctgctggaacacataggccaggggcttattgcactctacaggcccaggagtgggtgattactagctactgccaaggatgatggggagaggaaacacaaaagcaaaattttaagtgaatcggcataacggggcagtgccaggaaaaaaaaaagaaaacatcaacgaaaggccggccaaccaccctctgagagcaacggggtggtttcctttgaacacagggccatctctgaggccaataagggagctccacaagagttacagcaataaagagaataatgatttttttatagacacctagcctagatcggattgctggtcatgctttttctgttttgttgcttcaaagatacacccacacacctttggcagtgttatcctcaaacgacaagatgttacttctaagttgcaagacctcaggcgctatttgtcctcacccacacccaactgtctgccatcttcagcaccaaacatatccctgaggacaaaaatggcccttcagttcctgagtcgtttaaactgaaaaaccagttaaagtgccattcccaaaataaaacagaaacatggccactggcatgaaatatttacagctgtgagacaagggggaaaaaaagcctcacttgacctggtagtcaggggaatgatgtagctacacaggcctgtagagaagcactttggcctaaaatcgttttctcttttgggattcctactggcacctgtcactgaagctaaagacccaaaagtcatctccaattggtccattctcttacccctatatttaatctcaaatgtagctccatctgttctaagtctaacatttcctaaattggtgctctccttgcccactggacatccctctacagttcaggctctcaaatctctgctgaccaaagcagccacatcactcactttcttctatcccatatctccccctttcccattgctcttcatactgcaacagcatgacttcaaaggcccttcaagatcaagctcctacctacatttccagagttgtccattatctatccagtcccatttcttcacagcccagcaaccctcgtccatcctgaaacacgttctatgtgtgtgtaccttcacactgtggtgcacgcttttccctctctgcatggagttttctcagccctcacaaacctgcctacccatccttcaacattcagctcaaatgctttgtcttcttctcattccttaatttcctcaagttaggtttaggggctctctacactgtgctggctttgcccttttatatgcttttattatagcacatttcatactgtatggccatcatttaaatatctctatgtctactcctgtgtttatgatggtcagtcaggtgtgcttacaagaggaaacacggaagaggctcagggaaacaaagtttattatactcactggtcctagaaacaaaaggcatgctgatattgtttggcggtgtccccatccaaatctcatcttgaattgtagctcccgtaattcccacatgttttgggaggaaccaggtgggagataactgaatcatgggggtggtttccccatattgttctcctagtagtgaatacatctcacaagacctgatggttttaaaaggggtttccccctttgcttggctttcattctctcttgcctgtcaccatgtatgatgtcccttactcttctgccctgattggaggcctccccagccatgtggaactatgagtcaattaaacctctttcctttataaattagccagtctcaagtatgtctttattagcagtgtgagaacagactaatacacatacctatgtagggtcacaggggaagcaccaggttttggtcaggagacaaaatataatagccaggggaaagtctagaccagagcctttgttgggggtttcctcaggaaaggcaaggcggggtatagtaaacagattaggactgactaaattgagtaattctggtggcctttgggctctagggatggtctgtagttgcctggtacctggccagggatgcttacagtgaaggaatattgcttcctgtggtgtatgggctagacagaagaggtacggctcttgattggttagtttgcatatcaaaggcaatgctcctggctgagtcctgggctgtctctaagaattaacagtctctccccagtaagaaagatttttaagatgtaaaaacattataatacatagaaaaggaacaatgtaaatgatacaactcccagcctcaaactaaaatctgagttcctccctcctatgttctaggccctgttgaaagcagggctgatattctgctgacatgctgatatgtacaagtttactgcttttctacacttgcttcttcctgatttactaatcatactggttagtaaatatttttatcatcatcccaattgtgttttgaatctaactgctttattaactatcatcacagctttgtgaaggatgtattattatcaacattctacattatctgtagaatgtaggctcagaaaatgaggctcagaaaagttaaataacccaaccaaatcacagttagtaaacagcagagccagaatggggagccacatctgcttatactagaggctctttcctctccatgatactgcctctctgcactttgtttttccttctagacgcaggcatccagcacggtgcctggcatctagtagtcattcattaagtgattgcctaatggattaaggcataaatagcagtgatataaaatattttaaactgttcccatagctaatttactctatggaacaaaaaggctggaggtttgtaaccttgttttaaatgaaaaacaacacctcacaataagaattgcttactttatccaggtctgtaatcccagcactttgggaggctgagattggaggattgcttgagcccaggagtttgaggccatcctgggcaacatggcaagaacctatctctacaaaatataaacaaattagcccggtgtggtggtacaaacctgtggtcccagttactgtggaggctgaggtggaaggatcccttgagcccaggaggtcaaggctgcagcaagccatgatcatgccattgcactccagtctgggcaacagagcgagaccctgtaccacattgctataaagaaccatctgggactgggtaatttgtaaagaaaagaagtttaactgactcactgttccacagggtgtacaagaagcatggctgggaaggcctcagaaaacttacaatcatggcgggaagcaaagaggaagcaggcacgtcttacacggccggagcaggagaaagagaatgaagggggaggtgctacaaatttttaaacagccagctctgtgagaactcactcacagtaaggagaatggcaagggggaagtctgcccccatgatccaatcacctcccatcaggcccctcctccatcactggggattataattcacacatgagatttggatggggacacaaatccaaaccatagcaccctaacaacaacaacaaaaacagaattgcttatttcatcaaaatgcaataggttcatttcaatagctaccatttattgagtgactgccatgtaacataacataaactatgctaagagctttgtgttcattagcttatttcatcttctcaccaaccctgcaaaattgaaacctatatatatatatatatatatatatatatatatatatatatatatatatatatattttttttttttttttttggcatttcagatgaggaaccagaggctcagaaaagatatgtaatgctaatggttcagagctggtaaacaacagagcagagatcgaagttatgacacaatctccaaaatgcctgccctttccactaccccacgtaaccattttatttccatgtccttgtacaatttgcaggaatgagtgtatagggcaggaattgggactccatactacttggaagtttctgagacaaaaaggtcctatattaccattaagtagccttgtcagtaagggcttattgtagcttccatcttctgggcccagtgggagacatggtcatgggctcaggacccatctcctgctggaatcttattagtgcttcctctgcacaaataagaactggtgtattgtgttaaatggactgacacaaacaaccatgctttgtccagaaatagaaaatgctattttctttagcaaaatagaacataggaagtggtgggggttgaaatgtcatgcacagaacaaaggtttggcagaggagaaaggttaaaatcaatcactctacaggagaaaaaaaaaaaggtctgcagtattctatagtaattatccacccaaagtcacactatagaattgggagccactgctactcaaaaattcttttaaaaaggaaagaaagaaaatttccaaccccataatgttaaggttttacttttcacaaatcatttggaaaagatgatagatatacaactaaaaataaataaaagaatgccattttaacattctcacctctagtggtaggaagtaaccttttcatttaagaatgaggcagggagaaaccaaaattgctctctcaaaagaaagtaccaccagtatgttactactctgacttgtatgctagaggaaattagaatttaagttgaaaatgaaggcttattcactattcatatcttctggctaatcatcttctcttcaagagtaatgtccactaacattgctatagtttcacaaacctcaacgtggcacaactttctgggattgttattttttttttcttttctgcaaggttttcctattactttctacataagattacaaattcttcaaggtccgacctctgatgtttgttgtcctcatccccattgttttttaatcccatgatatttctcattcagaccaagaggaagttgctaagaagaatcataaaacaaagacagcaacatattggtttttagagtcaaatgctgagatatgaagtaaaagagaaaattttaggcaatacaattgatcaagaatccattaagaaaagtacaaagtaattaccctgtctccaagaacaaaaactatattctgcccatcggatcaagttcggggaagaccaaatggttcacggagactatgacctgttttctgatcagttgaaagcagaacaaacagaataaaggacttatatcaccacatgcgcgcacacacacacacacaaagatgaaaaaattagagatcagcctttctcatatgtatctatttatttaggtaatgtaagatggcaaacaagtattcagtcagaaaggtgaaatcattaaaaagaaaaaaaaatgtgtgccatgctttagcctcgatttgacctggaagcagaagagtaagagaaggaagtaaactggctcaaggttccatgagtcgactatgcacagtgtgattgatcatagtaattccccagatctaaagcctcctcctttctagcatactctagagagtcacttcttctgttaaatatatatttggattcctgtcactttcagctcttggttctcaattctttcttatcttgaacaagtcataagacactttctgagtattaaccgtccccaggaaactatatcccttacttaataagaactatgtaaaataagagataaaggctatcaggtatcctgacttcttggaagaatgagtcaatagaaatgagtttgggtagggagaaaagaattttaccatataagtaagatgaatattagagaatttgatttgggagagaaaacgctgcaaagatgatgctgatgagaaaagagcattagcatattgtcttaagtcacatacggtattctcttggggcctcaatttgtacatctgtaaaatggaggggttcagctatgtgagactgtgtttcttcctggctataatatttatgaattaagtcagagctgaattgtgattcagaattcaagatttttagctgtctgcttaagacatgttaaaaagccattttctctttggaactgctatatgtgtcagaaataaatccagtattcaggagagaaaacattctgcttcttcctccacacccccactccccctgtctgattgttgtttaataaaagccaagatagggaaggtccaaggcagactcttagcctggcctctccattcaatggattcagaattattctggtttctgaataagatgattctccccttcacccccagcatttatcactttggtcaaccattaaaaggatgaagcaaaagcattgcccagcaagaaactcctgcagctggcagaaatgaaaagcaaagatcttccctcacaggtcaaatctaactgacactacacagataaagctaagctgggagagcaaaggcagacgtgcaagcagttgaaactagagaggaaactattttgagttcctttcaccaaagattgtaacatatttgtgttgtttttttttttttatcagagcctcctggagctctctgacttttccttattaatattattattattattgaaagattttttttcaagcaattccctgattagctggaatattcttgctctttttaaaatctgcagtcatactatagtgtttcacccgagccctaggggcaatttgaaacaacgtctttttctgcttgtggtccaggatttttaagatcctacctgaatagatctgaagttttctgaaaagtctcctgtctccctgcagcccctagatgttctagagagaaagtgtcctgggatctgccactcagcacaccacttgctcttgaaagcacatagtccctgcttggaatccgctttgctcctcctggtagtcctgctcaaaatgggaacgcaaatgcctatgtggccaagtgaagcattcacttgcataccataggcttattctgtagctagggacatcctgatactcgggtagttagcataaagaagaaaactctgcgcccaggtgtcaaggtttcactggaagagagaggcaagcctgaggacaacagggaaggagaagggttgaggctacaactgggaggcctgatcctcggagtagaatgtgttttcaatgacggagaatgattaatgacttggaaatattttggaaagttgggagaatgacaagcccccttcctggccccatgaaatatggagtttaagggaagattggccttcactgcagagcaatttttttttttttttttaaaaaagggtattctgaggaagacaaaggttttttaatttggctgaatgtcattttgataaaaggtcgaggggccaggcgtggtggctcacgcctgtaatcccaacactttgggaggctcaggcagatgaatcacgaggtccagagctcgagaccatcctggctaacatggtaaaatcccgtctctactaaaaatacaaaaaattagctggggatggtggcacgcaactgtagtcccagctacccgggaggctgaggcaggagaatcgcttgaactcgggaggcagaggttgcaggaggttgcagtgagccaagatcatgccactgcactccagcctgggcaacagagcaagactccatctaaaaggttgaggatgtagggtacagtttaacagagaaaggaacgtttctgagcactcagtggaaaggatccagaggagggttaatatttggtggacctagaagtagggaatggcagagcaatcagataatttgggtttgagagaggatggacaatttgctgggaatggaagggtgcagtttgttggaagctaacagctatgtacctaaactttccaagggtcaagagagagaaagagtaggaactatcacacagttggcaggtgattacaaaatggtctgtactggcaggggcagcaagttctgtaatatgtggcctcatttttagagaaaataaaatcctgattggggttgaggggagatgaccatgcacataaacacacgtgtacataaaactagagtccttgcttttattgagccctcccatgccaaaacaaacaaataaaaattagtagcctgctgcagtggagcttgcacatgattatgaaataggccaatgagctctattgaggggttataaagattgaacatggggctcttcctgaggaatataagatgagtgttactaaattttgatattgatggaattctgcattcatgaaacttttaaatgctttggtagaatgggtaataatctgggagtcagcagacttgaattctggtccccaaacccctatttacctttgaaagaagagaaaacctaccgccaatgttttcccttccccacctcccctctcctccaaaagctagtttctgcctccacctttctgatgaatctacttaagtgaagctcatcagtgactctgtcctgccacagttgccatcccatgggtgctttcaattttaatgtaggttccttttcttccctgtttcccatgaactgagctttcctgcttttcatccactgaaccgcttcctggccctaatggtggtaatgcagggcccatcacttaatcatctttgtatgtcaagtaagagtataatgattatcaaatagataattgaataaaatgcttttgtcactaagctttgatatcttcatcttttcaaattaaaggtttggacttcaaaatctaaaatatatgattgtgtgctcttcttacagtggttttatgaatttaagaatcaagtatcatccacttagggaaaagagtccctcaatagaagattcttgagtttatcacataaaaaggatgtgacaatatagtcttctctcaaggtcccagaagcaatacatcagcctttttaggttgataccaaagctttggatatgtaacactgactgcttcatacatagataggtattaatgcacagatacataatacatagacatactgaatacaatggctttaatgctgccattatctcattctctttagaatatcatctaacttactgagttgtatattgtaataaaagccagcttcaatttgagtaaatagaactgttctttttagcagtatgtgcttaagaagctaattataattatacagatctatttatataaacacattaaaaatggttctgctgtttctatgtcaattcatttgtcatgacttggtacataattccttagactcattctttttagagtataaaaataatgcttcctaattacaataaaattagaataaagtcaaaaaagtagaaagaagattttcttgatcacacaaattcctaacattcagtggcattagatgaacatttggtgtatttccttttgggtatttttttttctatttaaagattatattttgctgagtttatttttaaagacatagtttatatatagttcttgaaaagaatatatgtatcatttccctgaaaatattaatacatgatcatcaagatatttggggataaattgccacttcaaaaatgcatcttacaaagagcattcacatggttttaaatagaaatttctaaatatcttattcacagtttacagtggtaatgcaccttttagataaatagagctaaataaagtacccagaaaattaatgcaatttaacattctcctcaaacactgcccctacctcttccctctcaacagttaaatcaccaggtacagatgccaccaaaatcttaacacaacaaccctaggaagcacatgatgaaaacagcattcaggtgccaattaacacaggcctcacttcctgaaacagctgtcctccagtcattctaatgtatcatcccatagtcctacttcctaggaaaagaagtgaaaagaaggaactgaatatttatgctgttgtctgactgcttttagaccttagctgaaactgagatttctctgaaggaagtactcttgtctcattcatctttgtgtacagtgactaggatcccacaaagcacaaggcacaagttttattagtatttgttgactactgaataaggccaagggcaaatggtcaactaggagtaatttcaactgcaagtggcagaaaactcaaaggcagtgatataagcaaacatataggtgtctttttcttatctagctagatgtccagaagaaagcaggtgttgatgtttgttctatggctcagcaatgtcaggggtgatatctctaaaattctctcagccttccccttttgcctcaagatggccgcattagcttcggtcacaaatccattttcaaggcaagagtacgccttgatgagcccccagtagacttccagttaaatctcattagcagtgttatatgacttcctcttgctgcaaaagagtctgggaaagtgcttgtatttcctggagcttgtgtctggagttgggcatagaatctggattctgttagcaacaaaaaagggagaaatgggtactggatagtcaattaacagtgtctgcctcaagaaatgttgttctccatctttttaaagtgaaaataaaaagtagaaattgaaaacagctaataaaacaatcaagaaaagaacatacattccatgcaaacttccataggtatgaccactcactgacagctgctacggataatagtgacttggtgagttggaagttgtggctggttcaacagcaaggctaatcaagtaacttgagaatgcgtgtatcttgagtgatgcactcaactacatactatgtctgggtctcttgtccttaaaaggggacctaatacaggatagaaacaaacaaatttgatttgtcaaagctagatgaattatgaatgtcttcctttggttttaatgcagtccaatattttaaaaaatattttatggaatttgtagaggtggaattggaagagactctatttagactatactcttcatcatatcatgcagcctctgcttaaaatttccagcaacaaggtctctactctgtaaagtagccaattcaacatttaaatttctctaatgatcagaaaagtctttcataatttgaactggattttacttctcagtgttatgcatctactgtttctaacactgatttttagagtgagcagaataagtttgtgtctccttgcatatgacagccctttaaataaatcaacaaagttgagatccctgttcttgtagagaaacaatttgggccttgaactcttccttagttggcgcaacttccgtagtccctttgtccacccctcattccagatagttgcccttctctggttactctgaagtagtgaatgttacttattttatagctcttgcaataacacaataacacaatatgcctataaccaaccgccaagggtgattgtagatgtctacaactacccttggtgtcgacactcaccatttcgattttggtccacgtctctgggcctaagaagattatttgacatccttactcatcaaatatgcaagttctccccctgaacgtatttgccaaacaagccctccatgatgtcatccaaatcgttagaataaaaaaattcaacaaggcagagacaatatgctaaaagagctttcctttctggttatcaagccatttataaatattggggtgaaactgttgttcaattgtctgttaaagtaccacaaaagataactctccatatttttccatttcatgcagagttctcaggattttcctttctgtctctccaccaggtaatttagagcctccataaatgatttatttgccatgctctccaccacattttaaacagtacaccacagatgtctggcactcctttaaaactcaggtggaaaaatgagggtgggtgttaacatttatgtaatttatgtacagttactaaataaacactgcactaggagatttatatacattatttccttcggtcctcctaaccactttttaaggtcttacaataccccccagctttttaaagagagattactaaaaagtttactgtagttcagaaacttgctttagaactatgttatttttctggacaccaaatacacgttgttttccaaacaaattctctaaatctttgacatcaactgggtgtccgacaatttaattcaattccaacaactattgagaaataaaaacaaaatcctaagacccaaggagacaccagagaaatcttaaaaactgagttcctggccatgacaggacaagtggtgagacatgcctcagtatgctcctttcttattaacctttaaccagaattctttcctaaggagtaaacagaaaccagctttggaaaagaagaaacagacaactcatttcattaatcacctttaaccaaccatctgaggccatgtctgcacttcccctccctctttgctgtttctacatgacaactcaccagtttcacaatgcatccttcctgaaaactaaccaccctctccaggctggttttggccaactcatggaggatgcacagtgagggttctcgtgtccctctgcttcaccttttgacatcagcgagctcaaaactccacccttggaccatgctaacaacaccctttattttcgaacatgtgactcatgaagagccatgaagctcagttgtgcatgcatatgtttctcctttcaaatattccttatatagctattaaatatgtatacttagccaacctgttcagcataaattcctgtattatgcttccttccctcaaagtgcttgctctcggtggccaaaggccatggttcctagcctgtggaatggccagtttatttctcttttatgagaaatagttttcctgtccaaatttatgaaactcatcattcttcagatgtcaatacccagagttgacacagatcgtacagctcaagggctcaatcccacaagacttctcccacttcagatgccaactgcaagtggggtgctcaggctacccacacttctgcccagctgactacaaattcaggggttcccacgaccctctcctcaagtttataattccttagaaaaactcatagatctcaggaaaacactacacttaaaggatagccaaatggaagagacactagaacaagatatggaaggggtagaggggtagtccagagcttccatgccctctccaggtgcaccaccttcctagaatatcaacatgttcaccaattaagaagctcaccaaacactgtcgcttaggagtttttatgaaggcttcgctatataggcacggttgactaaatcattggtcactggtgactaaattcaatctccagcccctctttcctctctggaaatcaaggggtggggctgacagttctaacattctagtcacatgactctctaaagcctctgcccatggtttagtcatctcattagtacacaaaagacagtgaagtccaagggttttagaaatctgtgccaggaaccaggggcaaagaccaagtttatattttttattacaccacaagatcccatggttagtaatggtagagctgtatttctaactcaggtcggcttatggttgaatttcatattctcctcttatgacagatttcctactgatgaatcaaattttatagaacgaaagctatattagtacaagatattttgagatgcgctccaagtagaaatatcctgtgtcaaagtcacatcaatctgaaaactggtaatcaagaaaattagtcttgagaaatgtgttttccttattctgaataatcatgatcagctctttaattgttatatttacccttcatacgctaaagcaagtcaaataggtaagaccttcgttctccatcacttacgtattactaactgtaggttaaggatccaactaatattttacagtaactttcacacttatcctttgcccactgattcactcacatactctcacgctcaggggtttatgtaactatactcatctagaaagcaaaaagaaataggtttatcacacacagaaagaattttaaaacaatgaataatgttgtaggaaaacagaggattatagcttgagtgacttgtgtaccaaacagtacagcatgctctgtgtgggtctgttcctgtcacctgcaaaactgtgtggaaaatattcttggaacagaaagtagagcctttttgtgtcatcctactccattttttaacagcttaatagaaatgactgaacatataattcatttgagtaacaaaaattagttataaatttccatttcaggctgggcgtggtggcttacacttgtaatccgagcactttggaagtctgaggcaggtggatcacctgaggtcaggagttcaggaccagcctggccaacatggtgaaaccccatctccactaaagatacaaaaaaaaaaaaaaattagctgggcatggtggcgggcacctgtaatcccagctacttgggaggctgatgcaggagaatcgcttgaacccaggaggcagaggttgcagtcggccgggattgcaccactgcactctagcctgggcaacaagagcgaaactccatctccaaaaaaaaaaaaaaaaaaaaaaaattaatttcaaaattttcagcaacaaaagaatctataccatttattgagctcctttgatgccaattgctaataacattaggcacctttaaaatatctaatccttgcaaccagctccacaacacagatgtcatatccccattttacacaaaactaaactgagactcaaaggttgagaggcaaaccatgtggaacatacattgttcttatgacatcttgctatactaaactctccatcctcatatccctgagaagtcttcaagaaccatgcagatatattttcttaaaaagatgatagggaaagaagggaaagcaagggaaaattttttaaaaagggaaaagggaagaaaaggaagggaagggaatggagggtaaggccagatgacacaaagcaaaacaacacaactactctacaccagagcatctggagaaacaatagctaaaattctgtatgtttctcaccacaagccagagattatattgacatcgtgtcaccactccaatgtgtttccaaatatcttggtcattcagtcaatatattcaatgagaacttctctgcactcagaatgttgtaataggtgctgtggggaaaatacacacgcaataaaagataagttgccacccttatggcactcacaattgagctaggtcaagaatataaattcatgaaatagcaggagactttcatggtaacaccttaaggacagatatctctagcaccagctatgaagccagaaagtggaagtgcacgagttgggcaggctcttccataagccagacttctcaatctggatttgaaaagaaccaaagaataggacgtgactttgccaccaagaattaaaactgaaggttctttattgtgcatgctgcgtgtcaacagacagcccatggtagactctacttcaagaccattatgagaaataagcagttcctcctctggactctcagcaaggtagttgatcttggtcccaaacactttaccctaccaggatgcacacttcaaaccttgaaactcttggtgataatgaaacaaactaagattctaagcctgttcctctgcaaatagttctttgtcaagattctatgccaaacagtggaatagtgtctacttctgttttagtaacacagtaacaggcacctgggcaaaaatgatcacgaaaataaagtcacactccatcatcataagtgatttatggatattccattttctgaggctgccgtgtctatttctaaaaccaaggtgccagacaggacgaagatactcgaacaacaaatggctgaactgaagccttcacataagcctcaagaatttggcaaggtttatgttgatatttaaaaccccaatatcagaacagttgtataaagacataaaaggacatgtttttgttcaggtgtctgtgactgatggagtgatttcagtgattttgagacagtgttttgaaaagcacatcctgacacacatcttgaggaggattagcaatcccctgtatttcttgatgtcccacacaggcacagtatacagttctcactgactggatgactgggtgctatattccaatactcccttagagaaggtgtccaaaaagtgacacaatgtaaactttgtgtttacatatttccatataagtccattttaaaatttcaatgatttttttctgaacgagcatctgtaggtccacgtagttccataaaaggagagatttctgtttcctaatactctgtgctaaatccctgttggctccatgtatacttaaataatctggagtttattcattataaaagacttagctcactggctcactgaatacactgattttcatccaacaaacatttactgaggaactactttattataggccttgtatccagtgtttggagagatagaaaaggacctggttcccaccccactcttaggtcactcagtctaaagggctgtcagaccactaggcaattacagtgcagtgtgaagagggctaaagaagtgcaaggtgatgtgcagccatatgggcgggaggggtagaagggagagccagcagaccagcctgaattgtacctttctaaatttacctttcttgtggtaaatccacacttcagccatgtcaggaacgatggcacctttttaggtagtgagtacttgaatcaatgtgatcaaatgcttctactcctaagaagtgacaattgagtaaaccatattctttcttatatttttaactgataaaaataatgatatatactatgactttaatagaactttgaatttatttactggagtcaccttggtcaggtgacctagcctctctaaacttcaatttcctcatctgtaaaataagaataacacctatctcataggtttgttttgagggtcagtgtagaataatgcacataaagcatttacaacagtgtctagcacaaagaaagtgctcattaaatagctgaagttttaaattatgaatgccattcgtgaatctctcttcttgccttccctcctgggacatgacaatttcctattcagctcaacatcctgcactttaagctctctcaatctcagtggtatactatgttcctcaagcttgtttaagagaaagcagctgatatctggaaccaaacttctactttattcagtgaaaaaaacaaacaaacaacaacaaaaaaccactcaatgatcttctgggtatgtggtgctggtttttatttttccataggagtaatttctttttcctaatactctggctctattccttttggcttccagaaagcaagaattactctgagatgcccagaccagactagacacagacacagaaagccagtgacctatatcaactgccactaatcatcagagtgagagaacagatacttccccttttctgtcaagggcagaccaatgaattaggcactgaagcagaccaaatgtgatctggtatcttagttctgtgcaatcagctacaataaagctaagtggtctgggaaagcatggcaaagcagtaatcatccctaaagtaactagaggaataactaagtaagtgtctgctaaaatacggtctgtaccttttcaagaggtgcatgtctccatttgggcctccccaaaactcgcttaagtggatagacaaggcagcctagtaaacaacctgaaaggcctgtaatctataattttgggatggtaaacaaaggtattggtcataaggtggacttactgtgcccttttattaagcatgagaaaataatttttctataaggaactgaatttgagctcatacttaaaagttgtggctgtggctatactacagaagggaagagttaatccccaattgtgcccacatgtgcagtggcagcagaaactggcagaaagaaccctgaactagccttgagtactattcttgtctccacactctctaactgcgggctccctgccagtaactgcttttgtgaagccactaggagctgctgactggttgcatttccttgttcatccaaaagctatatttagagtgacaacccctagagatttaagggaccctgagacaggtcaagtgacgtgatcctgctctgaggaagcctctcgtgacccaagccaagggagtaaactctacaacagggagaagaaatgggagaataggaagaagtaaaagaaggagggaattcacagagtaccaatagcatgccaggactagagctaggtgctctcacttacatgaactcatttaatcttaacaattaggcaaagcaggtattatcccattgttcctattctaaaatgacaggcaacttggctaaattaaaagagtaactaaagagttgaacttagggctccacaggctacttttaagtctattaccatggtttactgcctctgcatggagcaccctctggtgggcagggggatatccagactgagtgaatgccttctccagacctttttcccaaggacactgagacctgtagtaccttcctagttaaattggccgggagcctgcctgggtatgaaagggatactgaagcagctggagatttctgggtttgcttcagaagttctaggcacttcagcgtatttaacaaaaagtttcaaggaaagtagacctccttctttgggctatgaatcctttccagagacaggatatctatttagataaatgtaagtttcaattcttccctttctcacagtcctcctctctaaaacagaattagtgagtaacacccatcttagagtgatacagcctggtagacagtgttttggaagactataactctttaactcttggaaaaggaagaaaaatatacaaccctgcaatctgcgaagttcttgcacagatataaactcattgattctcagagaattggaggtacaagtatcgtcattcccattttacaaaagctcaagtggctcagtgacttgcttaagataaaatggttaacaggacccttgcttttactaagcaatttgacctcaaaaggcatgtctttctcattaaatacaccctttctataatcatgttaaataacaaattgttcccagggtaagagaaggggagtgatataaaattaagccattatcttattccttgctatggtttgaatgtttgtggcccttccaaaattcatgttgaaatttaatccctaaagcaacaatattaggaggtggggctttagaaggtgattaggccatgaggactctgactttatgaatggataaaatataaaatataaaagggattgagggggcaacttcacctcttctgtcccttctgcctgaggaaacacagtgtttgtctcttttgtaggatgcagcaacaaggtgccatctttgaagcagagagcatccctcaccagacaccaaatctgccagcactttgattttgaacttcccagtctccagaactgtgagcaatacatttctatttatagattacccagtctctggtattatgttatagcaatacaaagggactaagacatccctgaataatatttcagtggtataaggcaaaatgttatatatatatatatatatatatatatatatatatatataacaaaggaaacagacatattattttactcaagtggaagaaaagtagtgttacacaggaaagactttatgacacaggcagcaatttatcaatttatgtgggtcttctgtgaaagataagatgtcatgaacttaagacaggaatctggcaaaggaatgaaggaaatcaagtggaggaaaaactgagaaatcctagtattgcccaactataggttccatgagaggaaacagtgaaaaacagctctggaaaaaatcaatgtggatgatcctgaatgggcaggccaggtaaagcattaggcctttattctgccaataatttggaaccctgaaaggttctgagcaagagacagaatgatccaacctatcctactctggtactattgtaaagtacagattaaaatggggagacattagaagatatgaatatctttgcctcaattcacatgagaccaaaagggggccctatcagggttccaatactaggaatgtaaaggtggggtgaaatgacataggtagaaaatggatagaactcagtgagtgactggatatgaaggctagccaggggttgaaatcaagagctataattagggtttgaacctagctgatttgaaggacaatgacagaactaagcaagacagaggagacaggaagaggaattggcagggaaggggatatggtgaattttgcacatgctgagcgtaaaaaaagttttgattgattattcagaacgagattttcagcaaattcttgataatgtatagtagatctaaaacacaggaattacgtcaaaggtggagactcaggagtcaacagcataaggaagacagaagtgaacagaatgaccaatggagagagacgagagtcaagtgcaggaacccaacagaccctcaagaaagcacactgaaagagacaaaggagtaatattaagatggacaggagaagaacatgactacaacgccacatgataaagggagtgagaaacattaagaagtagattatggccaatagtatcaaatctcagagattcaaaggaagatatgggttaggactagactattagtgaaggtcctggtggtctttgagagcaattttaacagagctatgtgggctttcaacagattgaaagaggttagagagagagagagagagagcaggaagtggaggcagggaaagtgtaggctacaacttttgggaagcagacagcctgaggcacgtagccaaccatctggttctaaactacttttccaactttatccaccattttgctccaagaaataattttctccatattgccttgtcatgtgtctatcacctggctacaccagactcattctgaatattctgttttcgcatccactctataccttcaacctctctgcccattagaagttgcacattgaggcttacacagtctgcattgtgtaagactcagatcatgtcctaatgcctcatgaatcattttccatttatttcacctatactgatttctcagatctcataaagtaactagcagaataacctggactatgcatgcttcatttccttgtgaagaatgttatactgctatttaaataatctgcatacaaagcaagggagacttaagcctccctatgaaaccgaaagtaaaacttatttgccttttacattgtagaagttcaggctctgataatggagttgggcaagaactgtagacagcctgaaggagagaatgctgaaagaaaaaagattccctcagaagttggtggaatggaaaaatacagatgtaattagttataaaaataatcagaagaaataaacacaattatacaattataaaatttgataggcataaggaaggaggtgagctaaatcttaaagtcatgtggggcaacagataatgcatgtttaccaataaagtagtttacacatatattttagtgctggaatcacaactaacagaagatctaaaaatagaagtagttaaaagtagttgagtctagatagtgagtggaagcagggaggggcagggtcagggcactttaaaaaatacataggctgttcttttaatatttgctttgtttttaacatgcatatctattactttgacaacaaaacataaataaaataattttggtatgcccgttacttcagtggtcaggttggaccacctggttcaaatattcatttttcacaaaatccagaggagtcctttgacgtgggaattttcatttgcagttcattgtgtttagcttaagcatggctaatatatggcaaatttcaatttccataaagtaagattctgttaccaacttctaactcctacttagtaagacattgataaaccctagcccagtgtacctaagaatgatatttgcttggtaatgtttaaatgccagatgatcttttccattccaactctgttcttattccaccaaagggcacactagcatgttgctttgttgtattagagttcagattttcaattgcaaaactttttctctgtctatatctgtaagtgtttaaaattcaggttttaagtcagcaacacagtcaattacaccactaagcaaactttactttccatcaataccattcgcaaaaagcctttctgtctcatttccatctctgggcattctctgcccggctgccttgtgctctttaggccactgaggttgttgaaaagtcttcatttgcaagctcttttgtgggaagtggagcttcctggttgtatcataactagaaactggcctcctgttgggctgaaatctagcatccttatgtttcctttttaattttctaaactaccctcccacctgtagcttcctagaccttttctgtttggctatttcataccctgtgccacgcaagttttatttgacacaccacagccattcagatatttgttccatgtaggttaacttgacaaaaatagagtactaagatatagaaaactaccaatgtgtccccctacccctgcctgccaccatgccataaagttattacagactgacttggattttggatccaatttcttcttgaaaataaggcagactttcctaaggttgaaaaagcatgttttaaagaaaatagaatgaaaaacaagtctacattacagcatgaaagaggaatttcaaaatgtgtttaatttaaaacatccagtatgccatttgctatagtctgaaaggtcaccggttgcttatgttttattattttgcttggttttatttttaataattttgattctggagatcctgcatttcaaatcctaaaaccagtggcaaaagcaagtaagcacctagccaaggtaaggctttaatatctgactggtagaaagagacgcaggaggaagacagcaaaacaagtcaatgtaacactgctgtttgcacaggcagctgcagaagcaaggcaagatctgcagatgtggatgtctgacctttaatccaacaagagtctcactaaggattgaaaatagatcatttcagtctagtaggaaggtttgagacagatgtgctgacagaagaagaaagtctggcattaaattgtataggtatctgctgaccagaaaaacacagcttctaagaaaagagcaaaaccatcaggtctcctaatatttttttggccacagggttgggaaatgagattgcagatgtcaatatgggactacattctcaacaatttaagatttggtttcagtcacacatcccaggtgaatgtgtcccttccaaaattcaggtattgccaatttgatactaataggagataaggcctttaagagatgattaggccacaagacctcctcctttgtaaacaggattaggttcccttatacaagggcttgacaggagtttgtctctttttgcccttctgtcttctgacctgtgaggacgcagtgtttcctgctccagaggatgctgcatcaaggcgccatcttggaagcagagagccgccctcaccaaacaactgtggcaccttgattttgcacttcccagtctccagaactgtgaaaaaataaatttttgttctttatcaagtttccagtctcaggtatttgttatagcatcacacaatggactagaacagtaaggaacacagatctagtgacatgtgataatttctatctctgaaattagtatagtttacttttctgtcccaggatgaattatatcatcaaaaaaacaatagctttaatgtaaatataactgacacttctcatattgttgtatgctaggctctgtgcaaagaccttacttcatgacctcttctcagatcaatactgaaagtaaatgaatatcattcccattttaaagacaaatgaagggttaagtaagtcaattaagagttctgcatgtccccactccaccaaaggaagaactcaaagctaaacctttcagatgataaaaccaatgctctttcaattaaaagcaaagtagattatacagtaagataaatctgaatttgcctcctagctctaccatttactagctatctaaccacaggcaagccaatttctggtagtctcactatccttctattatgtaaaatgggactattagtctacttcttgggggcattcagtaaggttaaataagataatttatcttaaacattttgcaaggtagctggtttatagtactcaataaaagactagacaaatatgtctctccaatctctttttttaaagccatcataagtatgaattgtattttagtattttaattttcaattatttcactaatattatttgtgcatatacctacgtacactacaagtgtgaaactaggacaataatgtatcaagacaaaaagagaatcaattctagagaacttagcttccaaagagatgcctagaacacagagagatgagactaatcagtgagatgcctttaaagaaaaagatgcaaagacacaaggaattggtcaagaggaaaataaggaacaaaggaacaaatacttgtcacatttttaaagaaaattaggaattcaaatccgtctgctcaatttccaataaaaattaaaaaaaaaatcaacagaaggctaagtccactctaatagttggataagaaggaaatacaaactggaaataccatttggcattacatagcaggctggagtggcaccaaaggaatcaacatgtccccaaaatatgacagtagcttgagacaaaacacaaggaaatgctggagcaagggggaataatctaggctgtgggaatgggatttgctatttccttttgaatactggaccctacttttgtaaaatgttgaatgaggactgcactctactctattctgcactttgatttccatatacctactcacgtgtcagttgctttaactgccaagagcataagccatcaattgccagggagaaaagtcaaagaagagccttttttctcctgtgtctttcagttagagtaggcataaaggaactgactgctacaattcactttctttgtctgacagagaataatgatgcttcttttctcaatgtctcttaatccttcctaactagtagagaaaggctggtgtaccatttctcactaacatgttagaaaaagtagtcccccaaattaagagaacccccatttctcaacgtcttgatgatttccagagttttttttttaactaatatacaatttttagagcagttttagatttatggaaaaattgagcagactaagtatagagttaatgtacattccatatattccctttctcttccctgccatagttttcctgtgttaacatattgcagtagtgtagcacatttgttccagttgaactgacagtcacattactaactaaagtctataatttacattagagttcactctgaattgtacagttctatgggttttgacaaatacatactgtcgtgtatccactattacagtatcatacagaataattttactgccctaaaacttccctgtgctccacctatttatcactttctcccctcaacccctgagtctcttcggccatttctatagtttgccttttccagagtgtcatacgtttgaaatcatacagtatgtagccgtttcggactggcttctttcacttaggaatattcatttaaggtttatgtcatttcattaaagttttttttaacaactctgcataacaagagttgactaagtcatagataccttagtgttgaaaagtcagcaaaattacctctgacatttaggctagaacaagcctaaagcctagcgccctcccaagatgttgcacattttccctcagtttctatttcacagcgtaacaatttcccaccaggaaaaccttcttcatatctgcactaaattgctgaaatccttttagattttagtgaggattcaataggatagaaacgttctctttttctcattcaacagacatttattaagcacttatgtgcattcaatacattgtgtgccagactttgtgctagtagccactagaggcgtaaagatgaataaaacccagtccttattcttaaaatctaaatgtctttgttccttctaatatcctttgcattcttccaattaaagcatgttttgccttgtcactctccttccagggaaactatttaatacaattactcttagttgccaaacacaccaaatcaagaattaatgccaagcatggaaagtgctaccatattaacttaactaatcgaacttccattatttcccaagtatgcttacaattgtcacaaattcatgtgacaagaatatcctttgtaagggaaggtttaaaccaaggttatgactttgctatccatctgataagacatgcatgttcctatctggtgcctgccataatcttcttcttgcaactataaagattctccagctctaacttcttgggccacatttgccctactgcaagccacatgggcaaacattctgccactccacactccataccatgaagggatggggaccctctgaagctgcccgcccctgccggggcacctcttgtagccattctcacctaccagcctaaaccatgctggccacagttgcttctctatgactctgtaccttcccggcctgactttctggaaaggaggatacttggaaagcagaattcccacagctgttttgaggtttatctgtgcttcaagtttgaaaagttaattctgaaacccaaaatctgagcattgcctattctatctttctacagataggctatagcaaaccgtaggagagaaaaaaatgaaaactttactactgcctgaaaggggaacatggtaaatttagcagaaaatatgggggaaagaagcatagttgtagtatttcaaaacatggttccattatatgagtagaaaattctaggtttatttctgctttgggttaattaaaaagtgaccttgccaaatgacggtcagttggatacctcttatcatccttcagtggtattacatggtttttcctggaactacagatctgcattacttggttggggaggagtgggtggatatatttagaaacactcaataattaaaatcactttctacttaccttctgcaaacacatcttaatgatagagtttccttcaattccattaaagcacagttttaatgaaatctgttatctcagcttcttttaaggagatatgttctcagtaattctattttaagggggctatcttttctttctaatgcttaccgagaacacacacacacacatgcacacacacacacagtttgctgtgatctctccaaaaataaattaagaagtagtaaaagaaagtgagtggagttaggcaagaaaaagcacccaagggaagctgctagctcttttcaagtcctcaggaaaacagcataaacaaatatacctttttagcagtgtaatctttaaataaccttataagagtcatgattcacttttaagaacagctccttgaacttccttcaaagttcccatggccttgctgacgtcacccttccaaggatactgaggtcatacctctagactttttctggaaatactctgcactttataggaatgattaatttatgcaaaactgcttaattaccttgtgaaaaacacatagacaggaaatagagaaatcatgcatcaacagactagcaacgtgggtcatctgcaattcttcatgttcaagacaacaacctgcttgttagtgaagggatgctgtcctaaagatttgtcagattgtgttggaacctccctgagatagcaggtgaaccctaaggggatgtggagattggagttacaggacccaaaagacagcccactggtggcagtagcagcttctggattctgtcagtgggtataatctgttaattcaatgtgtcctggcttcagcttccctttggactttgagatctgctaaaagtttatgagagaaaaaaaaagtgggtagcatttgtttttctttatatttcgtcttctaaactcccagatgtcaattggtagtagtggtagtattggcagcagcagtggtagtgccagtagtagtaatagttgtaaaaagaacagtagcaactaacattaattatgtcttataaaatgagcacataaaactcttatatcaaatctgagatatagctatttacaatgttcttctacaaaggaagaagctaaacctcaaaaggagagtgacttatctgcaatcactcacaattagtaaagggcagagacagaattcaagcccagacacttgcctctaatacccttgatgctgtgtgataatatgtaagaccataagatgaaaagccattatctcagtctctgattgaatactatacaaaagtagtttgttgcttcattcgtattctgcttataaaaatacactcaacaaatgacaccatggtgtttcacattctctccacagtattagaaaactctggcacagaagttatcaatatttaaaaaaaaatccataggagttaccatcttctattcacattcagccagatacagatttctttaacatacattattgactactaacaatgggcaaagcactatactaagtgcctccacatacatattttgatgtaaccctaatagcagataagggagattgcattatttccacttgctagatgaggcaatgtaagaaaaagaagatagtcatgaatccatttaattattaatttattcaaccaatatttgaatatctactacataccaggcaccattctaggtactggggatgcaggaatgaaaaaacagaccctgctcgaccaaggtttaattcaagggaaacacacacacacgtgcaattcaaaaagatgtcaggacatggtaagtgccatgaagaaaaactaaacaacacaagggataaatattgaggtggtggtgacagggaagcccttttacatggaaagcctctctgatgatgacagttaagcagaaacatgaagtgaaggagtagatatatgggaaaagagcactctcaccagagacacatttatcaaaaccgacttcgtgccagtactgagcttggtaccgtagatataatgattaatgaggcacggtcttgacctaccaggagcttttggtctatttgtgaagacatatataaatacattattatagtatgatccatacacgttcagggcattatgagcagggccaggactaggacaaggcaagcaaacaacttcattttaaaagcagacaacaccaggatggctgatttttgtcttgtgcctcaggttctagtatggctctgcatggcactgattataagtacatacaggaaaggtttcttaccctcttcctggggaccggtggtcctggaactgattacatatgagctgagccttaactgatagtagcagctaaattcagtgccttgtcagagtcacagagcccaggaagtgtacaacaaggcttcaaaatacacatttctatattaaagatcatggctatatctacctgatcagcatttcctgaagtatgtttgctgtgtttgcagagcagtgaatccacaggatattaataagtattactggaaaaactggtttggtgatcaaataagcttgagaacattcagcatataagaattttaaccggcttctttattgaagaacttttcagagacttcgtaagcaaacaatacccaccactgagagaagcatttcttccttcacaaggacaacagagaagcaaagtgcaaccaaacaacaataatgcaactattgtttattgtgtgtattacaggccagcactttacacatacatatatacatgcaaagtacaaactatgcaatatatgtgtgtgtgtgtgtatatatatatatatacacacatacacacacacacacatatatatatatatacacatatatatgtatacgtgtgtgtacgtgtgatttcatctttataataaccctggaagatacttgttattatttccattttgcagttgagaaaaactgaaggatttaaagactctaacaattagcctgaagttatgcagtttatatgtagcagacccaaaggctttgactccaaagtttgtgttttcttagacactatactgccactctggagtctaggtaatattcagagactgcacaaaagctggcgaaagtacctctggtggattcacgaatttgaataataaaccagaacagtattaattccaaatgatttgggaaacaagcctatagaaccaaatgaactatgaagatgctgaagtttgcaaagtcgattttggtttggttgttttctgagccccgtgtgtatccacctatcttgcaggtttctggtaattatgaaaaacataccattttccgagtttttttttccgtagataatactgttttactcatttttttttcattcaactgagagtgtatgcaacgatcctctgtatattctgaacccaacaaggcaaggatcttgggttatgtcagccttgccttccaaccacatgaccggttggggttgtcctttctatagccacaaacacttaacccagtcaaatttcttccatgatcaaaggggctgacttacgagcaggaacttcatgagcaaaatgcataaaaatataagatgaatatcaaagggagacccaggtggcagattccctgtgttatttttagttagaccaccaaaacctttttgtcttcataaacagaacctatctggattcagccttattcctttggagaagctgattaaataagaaaggaattttgccactaataggcaatgcccaacaaaaatgaggctcttgtggctcatctcaaaaggaaaagctacaagaaagcactgaatttgcaaagaagtgaacctcataaattgtgcacaaaaaggttttgaagattcagataaaaagctcagttccagcatgaccatctgttatgtccccctaaaagaagataactagtagtttataaaagcaataaaacagttccagagctcaaaggcaatagtaaggacttccagttacaaatcagggaacatgcagactgatatccaactgagcgtgcttccattaccccccgcactgcctctccagtcagaaacaaagattctctagttactggtgtctgatctactcgttttctccctcaaagggattatgattgggcatcaaagctgctgtccctctttccttctgttgatgtgcactgcttaattttttttatctggctaccttttccatacacatatatcatctttgacctcttccatctcactctgcctcagcctcttccaagtcttatccacttttcttagctctccacccccaccccaccatttgattgagtagtgagccaagactggaatcatatccggactagtcagtatgagaagtcaatgatatacctggtcaaaaagaagaaagtttaaccataaaccagataaatcaactcctgaaactgaaataaaaggctcccatagtttctcccctcaagcctccttcccagcttcttaatcgagctttgcagtcaagagtttgggcaaaggcttgtgctgcctggaccgtaatcttggctgtgcactttctggatatctgaccatgggtgaattacttgacctttaaatccctcaatttcctcattggtaaattgtgcacaggattaaatgaaataacttatttaaagtgtataacacaatgcctcacaaatttttaagtccacaattaatgttactcatcattatcagcagcaacagcagctacatctttctccaattaaactgttatttttttgctcttaccctccttttgtagtaattactgactgcaactatatttttcctattcttttattacaaacacacactaaaattacttaaataatcataggagcctagctttggccaatgataatgttagaggaggtgaagccaggggaagacccaggctacctggtgggtacccagttcagggcctgacgttcagatcacaggctctgctcgaggtctgattttgtcagcttgctaagaatggacccatctctcaaggggtacatttgaattaatcaaactcaggaaacatttatagaactgcaacacctatcttttaatttacaataataaacataattatgacagagctgtaatacttgtggcaacaaaaccagagaaatgtctccctgtagatctatataagaagcccaattttaaccagaagttattaggcgagtatgcaaataaaacaagagagttagctgattttagctatactccctaaaacaggctgatgcatctattttccagagagacagatctttcagcagtcattggctaaagctccctctacaatatgtagtaccacctggggatgctgccagtggttgttcaaggggctaatttctcagttcttccagggctaagaactgagtttcccttctttgagtaacattcttataggccccaaagctattttgcttcttaaaggtaactttgcatatctctgttctgatcaattttatactaattttatagttgcactccctagggggtattttttttcccttacacataagctcttgggttgaacctcaacatactaacagcatttactatttccattactttgcagggaaaataggtatgtgggaagatgggggctactgaaggtccagttatgtatcatattactttccagaaaaattagcttcaagttccaagtaaataactttacaaatgtatctgacacttgctcccacaccctccatctctattaataaactagccttatgctaacttcatttttaagctaaagagtttctatttctaacatacctcttctcaatgataaagaggtcattataatttttggcataaatgtggcaaaaagaaaatggtgacacttgtaccacctacatgatctgcaaaccacagttaagagttgttaataacatgagaaatttttgaatttaaagggttaagtgaaaggaatcaagattaaaagtcatatattcagaatacgggcagtataccatagaattcatccttgctccgaaacttactgcctggggcagatgccttactctgctgtgtctaatcagataagccagtgatgtatctttttgcttcagtttcttcatctgggaaatgggaagaccgtgcctacatcatagattgtaatgaggatgaaatgagttaatatcggtgaagtatttagaacagggactaacacataataatcactcaataactgttagctctttatcatctccactacaaaaatacaattaaaaaactagggagaatatatccaaacattattatctacctctgaaaagggctttcttcctctttatagtgtcctgtgctttctccaaattttgtctaacgcccatatactactcagataataaaaaaaataaactttttcaaaaaattagctcagttggtaacttttaacctgaaataatgtttgccaaaagcccctttaatgatgccactctagattcataactgcatcacttttctactgctgccgtaactacttaccacaaacacagtggcttaaaatgatacaaacgcatcatcttacagttccacaggtctgaagcctaacacaggtctccgtgtgctacgatcaaggtatgagtagggctacgttcctttgtggagacaggagaccactgagttgcactgcctaaaatagtagctgtagccatacatagcgatttcaactaattacaattgaataatattacaacttcagctcttccatcactctggccacatttcgagctcggtcgccacgtgtggccagtggcttctgcatgggacagcacagatgcaaaacactcccatcactgcgcaaagtatggacagtgctgagctagagatgtgactcatatggacttactcactggcgttcttgtgctttaggcatcttttcagatacaaatgggctcaagtcaatctcctgtttaaaattcttctctggtgtctattgcttataacattttcccaacattttagagctatataattcaaaccaaatcttatatatacatcataaaatgtagctgctgtcattataactctagtaggtgcttcaagacctccattagcctcattccgctgtaaatatctgagcactttgatactatctgtctaaagacaaagtgaaactccttagcatggcataaaaaactgttcttcatctagtccccgccccttcgctcttccccagagaccactccactattccctttcacccttctgtaacttcatacatgaaatcccctctactgcaatgtctttctctctttcctttttctttcttttctttttttttttttttttgagaccaagtctcactcttgtcactcaggctggagtgcagtggtgcaatctcggctcactgcaacctccgcctcccgggttcaagcaatttttgtgcctcatcctcctgaatagctgggactacaggcatgtgccaccatgcccagataatttttgtatttttagtagagacggggtttcaccatattggctgggctggtctcgaactcctgaccttaagtgatctgcccactttggcctcccaaagtactgggattacaggcatgagccactgcgcctggcctctttctctcttttctacctacaaaactcctcctcagccttcaacctctaactccatgttcgccatggggagaagcctcctgatggagaattttcactcaggccaggtgttctcatacatattgagagcaatcacatggatagacctttaaggacttttctgtgaatccccaaaattgtatgcataatttcatgtgtaggtacatttagaaggtacatgctctctggtttttctacagttattaactggccagtgaccccaaaagtttaggaacagtgctagagaaatttcagggttcaaacaggagtcctttcagcactttatgatccctcttttaatctgtttccaaacatacctttttatttttaaatttccttacacaaatacagtcatgtactgcataatgatgctttggtcaataatggactgaatgtaaaatggtggtcccataagattataataccgtatttttactgtgccttttctatcttgagatatctttagatacacaaatacttaccattgtgtcataaatgcttacagtattgaatacagtaacatgctgtacaggtttgtaacctaggatcaacaggctataccatagaggctaggtatgtagtaggtgtataccgtctagctttgtgtaaggacactccatgatattcgcacaatgatgaaactgcctcatgatgcatttctcagaatgtatccctgtctttaagtgacacaggactgtgtatatagtcaattctgcagtcttgtcttcaggttagaagcatatgccccattctggttcattctctcatgacatagaacgccaggttctccaacatatgctctctacaagaaaaaaaaaaaaagaaagaaaaggtaaggcagtgcacattactgaactaggaaaatatctctaccattattaattcaactttgtatattttagaagacaatactaacagcaattacagaggtcttcacgtgccaggtacagtgctaagtggtttacatatagtatcttaattaagcctcaaatcccttgagaagtattatctcaatttttacagatgagaaaacaggcttaagttacacagctagtaaatggaacactgggattcgagcccaggccatccaataagtgggtattaaattcactgcattcttgtagtgttcttagttctacctgaataatcactgtaaaggatctctcttaaagtgatatttgtggctgtctaaacttaaagatcccaaggaaaagcgtgaagatgttaggtgaaatgttaaaatcattcccttttaaaatggagacaaaggatagcattatacagtgactatatgttagataaaaacatatcatgaatctacaaataaggctgtcactcaccgactatatttctctagggaagttccttaaactctcagtgcacagtttcctgatatgcataatgggggccataaaaatatttggttcttgaaaataaataacataggtatgatggttaattttaggtgtctacttgactgggctaagggatgtccggatagctggtaaaacattattttggggtgtgtctgtgagggtgtttttgggaggtattagcatttgaatgggcagactgagtaagatcactctcaccaatgtgggtgtgcatcttccaatcctttgagggcccaagtagaacaaaaaagcagaggaaggatgaatttgctatctttagttggcttgtgacatcaatcttctgcccttgcatactggcattcctggttctggggcctttggactcagactgaatcacactactggcttcccttgtcctctagcctgccaatggcaaactgtaggacttttcagcctccagaattgtgtgagccaattcctataatcaatttcctcatagacagatagatggataggcaggcagacagacagacagagcctactgtgtttctctagagaaccctaatgcaatgatgaaatacatgttagtaatggtcattactgttgctggaaaacaggtttgaggtggaagaatattctttctgatttattggccttcctaagtgagctaagattactgagctgaaggttgttaagactacctgctcttctgcttttgtctaagaaggaaatgaatcagagaaataagactcctgcttcatatgtaagagttttatggggtagtgaccagtgataaatgtgttattctctaactatcaggagttggagcgaagcaggcagatgagaccattaaaaatatgagcccctaaacacattggggctactgcagctggctttatatccagctcatcagaatgacatcttagatctagccctgctcctccagatctctccaggactgggtgcacaaagccaaccaaatgaactctggtccacaaagagacactaacattatgtctgttataaccacatctgctccaggaaatatttcatgacccataaaagtcctctatcttggtggccaggaagggaaaatgcaatggctaagtgatgaatttctcttttggtttgcggccacgtcttagtttggctgctataacatgcatttataattctggagtctggaagtcctagatcagggtatgaggttcttggtgagggttgttttcctggtttaaagatggcccctctttattgctgtactctcacatgacgtaggtgtggagatacacagacacagacacacatacacacacacacacacacacacaccgagacagagagagagagagagagagagagagagagagagacagaaagtacatgagctctggcctctttatctttttgtaaaggtattaatcccattcatgaggcctctgacctcatggcctaattacctcccaaaggccacaccgctgaacacattgagaacttaggcttcaacatactaattttgaaaggtacaaacattcagtccacagcaagccatgaaaccaaaaatgctcttatattctggttttacatgtagagtattaaagagagcttcatgcagatgaacctcacaggataacagaagttgaagtgtgtggttttaacttgtaaagttattccatacagggtattttacaatttttgagttaacgcaaggctatcctataattttcaatgaagaattttgcatacttctattaatgcttgacattctaaagccatgaaacacactttccgttcctccacagtctccccagctgtctacttgctgtcccttaaacatactgaacccattcctgactcctagatttagctccttagtgttccattctccatgtggaacacttttatctctgcatattcaaacttatctaaccttcacattttgtcccaagccccatcttatatttagatgttaagacttctccaattcctgccatctctagtcaccttgcttacaactgtgtatattccacagtgaattaatgtactctatgtgccaggaagtgtgctgggcactggagatgcagcagtgaacaaaacagatgagtggtaaacaaggcagaggaacaatcagacaaaaattaaaattatatttctatagtaaaaggtaatatggcaagattaccaagacggacttcagaatgagaagagatctcaccaggttttctgagacctagggtgatgctagattgggtcagacctcactgtgagctgtcctgggaaagaatcaaggtttgagactagtagttaccaccacccaatgaagtgtagatagaaataaaccaccagtacacacacagtttattgtggataagtctggagttatgcaaagcctatcctctcctctcaagatttagcgtactgtaccattaatgacacacttctttgcctcctttataaaatgaacaggtctttttaagttctggtagttatcgctctttcaaaatatcatatcaatgctatctttcttcaagcagcataaagtgaattttgaagtgttttattctgatgatgtcccttgaaagatatccacttgttaagtatctctcatgtaattttcagtctaaagtccatcatctgtagacagaagtgaggacagcacagttggaaagaggcctaaagctgttattttaaacaaatagctagttacaagtgctggtgagggagagcttttccatttctcttttcatacacagactagcttgtcactgcagcatttgtgtccctcatctgatcagctagaggggtgtccagaaatcccctagctacaatagccacttgcaaactccagatacatcaaaacaatgattaataaaatatatctataagcgtgtttacagtcacagggggttaagagggaaatgaaatagcagctattgcaaactcctttcccctggaattcataatttatttaccttgtctgtcctgttcccggtgtggctacaatcaattgcattccatgtcaactcctagtaccacagtctactgtgcctgcatttctagctgtacacactaaaaattctatgaacactttcaagaaaatatcaacatctacatattagttatccaggtgaaatataattgctactagaaaacgatctggggggcctattcttccctgtagaagtgtccttagagagaagtatattaatcagggtaggctaagtgaggaaagaaccccaaaacctcaatgacttaatataatcaacaattatttctcatctatgccaaatgtaatgtggatattcctggtctggctgttctcctaaacacaaactaggggatccaggttccttccaacttttactgtttgcaactgcaacataacataccactattttcatgcaataatatgagtgtaggcatggcctaccaaaaatttaaccacctcttccaaagtaacacataataatttaggttcacattaaataagccagaaatagccaaaggcctcacctagattcaagagccttgggaaatgtaaacccggcaaaatggcattcaacctcctggaaagggaatgccacgttgccggtgatcagctagccatctctgttctgaggacctaatgtagacatattttttaaaaacacacacacacacatgatctaccaatctcaactcttaccaatcctccaggagattatcaatgcctggctcctaagtcctcacagtgatacagtcccggtttaaagacaggggcttaggaggccaacaaacctagattcaaattctaacccatcacctagcagtggtgtgaccttgtgcagatagcatatcccttctctgcttcacctcaacaatggagataaccctcatattttattcacagggttgttgtgaaaattaaatgatggggcgtctcaataaagatacccccaaaatgagaacaaaagctgtttaattagaacttgatgtaacaaggagtcagccactgtcacttgcatttgccagagtcaaggtcaggcagggaatgagaaaactttataatgaaaaaagggaaggcttcaggtatgctttgattggaggctgctggcatggggaagctagatgggctaaccaggaccagacatcttaagtgattggcttgcgaagcatattggactttctctgcttgatcctgagtggtaactggcaaaaattaggggagcagagggtcactaaccaagtcctgataataatgggctgatgctacagaagttgtggtgtggtgccccgggttggtggctgtgcagttcctgagtcacttgtcacacatggtctggcctttgcccctttgcttgctcagtctctcatgagccattattttttccaaattggatggtgggtctactcttctttcacagacaaaggtgatcttcccagttctccactcctatggaagaactttaatcagaatttttatgttcttaggcccttgtgttaagggatgagaggcagggaaaatacaagacaatagctttaaattctgtgctgtctggcaaagccaggtctaccactaagctacactgcatagagcaaatctctccatagccaggtgaagccactattaaagagcaatagtgtgttctacagtgctgtgaatgaatgggctttccaggatgctggagagctgagggcagagaaacagtgctcagaaatgcctacacactgattgccatttcccccaggtgaggatggaatgctctgacctgagtttggctcaacaaccagcagagcctaaagtttgcaaatatctccttgaagaattaagtacagagattttattgagtgtgtagattcgttatgaatggtgagcaaaggcacaatataaagtgactctgacccagcacaaacttaagcttcttggatcctgcaagaccttaccttacatggataatgttaccagcagctacatgcccccacctcacccattacagactctggggcccaggtgaagcggcaggaagatattctgcagctgcttttgctgtgtgttgtcatatcgcttctgctaagtttctgtatccttgactaagcctcacacagcatgtgtgtgtgtgtgtgtgtgtgtgtatacatgcacacttgcactccagggtttggatggttttcatcattaaaacatagaccacttgaaattatgtaggtgtcctgggtcagaccacaggtggtggccagtctcagccacaagcctcaaaagagacatgtagcacatttgaagaaagcaaccaggacaaagagagacttaaataaatgacacatgagaatgaatagttgaagaatgaaaggaaggaaggaactaggggatgttaaacctggaaaaactgattcctgctaatagcaccatccaaaaattcaatgtgttttccctggattggcaggaggtaaactagctaagtctctatcccgggacacatttgaacaaatgtaacaatactatgtttgaaatgttcattgactccttctgtccacctctaagacttttcttttccctcgtagcccttgattctttacaagcagccaagatgcctgtcctcattgcctctgggaagggatgaacacaaagcagaggaaaatggagcccttttttatatttgtattccaaagtctagactccagggaatgagaacgggaaaaaaaaatctcccactatactagaaaccaaaaccatgctctgaggcagaaggtggagacagacttagaggtttttgaactcagagtctgtgaagctcaggatgacagcatttacctggagagaccctgtaggcaagaaccaagtcaacatttgcagatggtccaaatttccctggaacaaggtccatacacactgcctgtgcctcagggtgctgcattctgcctgcttcagtattttaagtacacggatgcctgcccgggaggcaagaagcatgtgaggggcaagacttcgcacagcccctggaagactcatctcctgaggggaactcactcccactacagcctcacaacagtccagatgtttagacttcagagattaaagggcggagagtggaatgctaagcacctagcaagatgaatttggtgataaaaggcctaactactacgctttggcagagttgaagagaccaaccccacatccccctgagccaggaaagtagaaaattacacacagactgaatgatcacttggcatggggttatgtaaaggaaatcaaattaggagtctgtgatagttggggttctccagagaaacagaaccaatagggcgtgtgtgtgtgtgtgtgtgtgtgtgtgtttgtgtgtgtaaagggacttatcataaagaacttgctcatgtgattatgaatgctgaaaagtcctaacagctgcagggtgagttggcaagctcagagacccagaggaaatgggatatagttacagtctcagttccaaggcctgtgaatcagaagagctgatggtgtagtcccagttggaaggtcagcaggttcaagactcaggaagagccgatgtttcagttcaagtccaaaggcagaaaaaagccaacatgttagttctaacgcagtcaagcaggaggaagtctctcttacttgggggagggtcagacttttttgttctagaagctctcaactgcttggatgaggcccgtctacattagaggacaatctgctttattcagtctatcaattcaaatactaatctcctccagaaatatcctcacagacacacccagagtaatgtttggccaactttctgggtactctgtggcctagtcaagttgacttgcaaaattaaccatcaacagggtctcaatgggatgatgatgaagacctttccaaacatagatctacggtgtttaatcaggaggggatacaggcatccagaacttggaaaaaaagaaaatgcactggggaatttgttgaggcttatgatgtttgccttatcttgctgatgtttctttctaggaatatttcagtgtagccagtctgtgttcatcttcagtggagcatccagctatggcataagtgctttgcacagttttgtagttaaatccatgttatttatccagcataaaaccaattttttagagacataaatagcaaaaattttccaaggctataaaaattgttcttccaactttccggataacctgatcttctggacccagtcaagtcagtacaacgtggtgattaaaatcacatgttctagaatatacaggcccagattcaaaccctggctctgccaagacattcacaatgaacttcagcaagttatttaaaatctttgaacctcagtttccatatctacaaatgtgaagatagtgactctgcttacacttattacatcagaggatgccagtaaataacttagccctgtatttgccacagcccaaatgcttaagatgtattagaagtggttataataacttggatggagttctttaaaatgtgctgccggcattgccctgacaacttttaaaaacacttcctctacttatcctttctcttcctcttgcatcccataacttaactatccataacaactaccactgattttcaaggttagcagatagatttctggctgaaatactggaggataatttctccagaaaccaaggaagccatttacgaagggcaggtatttgacttgcatgccagaaaggtggaaaccagagaacaaagataaataatcctatttcctccttcaaattaaagctttgtgtgcatgcatgtgcaccagaaaatactgacttaatcagaagcattcaactaagattagaaagagtaaaatacagcctcagaactgagggaagcacagtaaacaagcagttatttctacaaaatccaacctcatgacaatgctcagtatcactgatatgtggatatgagcaattccagaaagtagaataatcgcaccatttgacaataatgtaaatgctatctcctttactatgttgctttacctctggctgtgagtccggaattttccagagagaagacactcaagaaagatgttgccttgactacttttaaagatagatttctagatgcaaatgtatttctagatgcaaattttcagtcacataaaaaaaaaaaccagcaggtcagctatagtcttgttattattttaaactacactggtttcaaccaatggtttcaagaggtagatgactttgaaaggatagtttctttagagaaagtttcacagacattatcagtcaagggagataccacatgactgaatcgtcattatcccatatggaaagagtacctttctgcacaagatatttgtcaacaattatctctaatatatatgaaagatctttctattttgataggattttttgtatatatatatttctattaaatacatatggtgaaattttatccatagtaaaagaaaattcctatcctctcctggtaagaaattatgtcaaaatgagaatgtgtcattagtcttcaggaaggccaaattaaagctcactgcgatactccaacacacacattagaatgataaagttgaaacaaaacaaaacaaaacaaaacaaaaactctgactatacaaagcactggaaaggacatgcaggaaatggaactctcacgtgcttgtgatagaaatacgaaagggtacaaccactttggaaaactatttgctgccgggtgtggtgactcatgcctgtaatctcagcactttgaaaggccaaggtggggggatcacctgaggtcaggagtttgagaacagcctggccaatatggcaaaatcctatttctactaaaaatacacacacaaaaaaattagcttggtgtggtggtgtgtgcctttagtcccagctactcgggaggctgaggcaggaggatctcttgaatccaggagatggaggttgcagtgagctgaaattgtgccactgtactccagcctgggtgacagagcaagactccatctcaaaacaaaacaaaacaaaacaaaaactatatggcagtttcttacaatattaaacatacaactgccatataacccaagtattccactcctaggaatttagggaagagaaacaaatatatatgttcacatgcagacgtcacatgaatgtacacagcagctttatctgtaatggcaaaaaactaggaacaacccaaatcaacatgaaataaacgggtaaacaaattgtggcacatccatacaatgaagtggtactctgctacaaaaaggaacaaattattgatacatgcaaaatggataaatctcaaaatcattacaccatgtgaaagaagttatatgaaaaaagagtatatatagtatttttccatttatataaaattgtagaaaattgaaacattaatttacagtggcaggaagcggatcagagatgctgtctggaaaggttttggaggaaggaatggattccaaataggcacaaggaaattttgagggatggtggtgatgttcatagcagctttatttgtaatggcaaaaaactaggaacaacccaaatcaacatcaaacgaatggataaacaaattggtgatatagataaagatggtggtgctatagatgtttgttttctagatgtagtgatggtttcatagacggattcacaggtcaaatctgaattgtacattttaaatgtgcgtagtttattgtacctcatttagctatcaagcataaaaacaaaaaacatctcctttgtgaatttctcttcctgtctcttattttgctccatatatatatatgtatgtatacgtgtgtgcgtatatatatataaatatatatgacacccactaacagcgtcttcatttccccttgaggaatatgctttcctgattctcactccttcaattcctgcattgtggcaagcaggaaagccatgtgattcagtcttggtgagaggaggatatccttttagccagtgtgatagttaagagacaaggtgtaccctaacctgggccaatgagatcagactaggaagtcctgaattaggacttctcttcagatcgcagagaaagagcctgacgtaaagtgtgaaaatgtaagcatggagctgcaggcggacatctggctccaccaagggaaagcctgcctaaaatggagccaacacagaggagagatggcacgatactgtgtgagctgctgagttcacatgtgcctgaaggcagacctatctctgtactttcagttttgtggccaatacatttcacttctcattaagccaatctcagctgggttttttgtcacttgccattatctcttctcctcctggccaaagaatgacgtgtgatgtccacgggaaagtattacatatttggtagttttcccaccagtgaaaaattgatgggaatgcttaagtgattttaaaaacccactagttagctcttctaaaattacggatggtggtaaatgaatagacaatttgacaagccagaggatgctcatggtatggtcccctctactcaatgtatctcaagataatcctagacaagatgaacacaagaagcaaaataactcttactagctgtgtgactttaggcaagttgtttaaccagagtctcagtttcctcattttaagagaaggctaatggcagtatctacttcttgggtttttaggacagttacattaaaccatgtacatgaagtccccgccctaaggtaagtcctcaataaatatttgttgtattactctttctaagacactagtaatctttacctatactaaaaagccccagtggttctcccttctcttaacaaaaatcttatgcattcttcaagtcccaccacctcctccaggaaaatctcccttgattacttcaatacacaatgtagtgatttctttttttctggatttccaaaccatttgctacaaatgtgtgtctgatacccttatcttattttgtcataaactgaatttccagtcctaggctggagccagttcacattagatctttggagttaattatcaaattttcagaaattttgagagatagttgctaaatatcccattatttaaaaattaaattacagaaaattatgattaaataagttatattaaaaacgaaggcaatacccaaaacataatgctttccactatttgtataacatttatgatattttgctattatctatgctcttgaaattatgtctgttatatatgtatagaggacactataaaatggagtgttactttacctctctttctgaattcagtgtcatcatgttggcaacctgaaacttgcaattggtcatggcaggagaattcacaccttagaaatcagcaaatgctgcaaatcaggattccacatccctgcttttctttgagacgcggtctcactctgtccccaggctggagtgcagtagtgtgatctccgctcactgcaagctccacctcctgggttcaagctcttctcctgtctcaacgtcccgagtagatggattacaggtgcatgccaccaagcccagctcatttttgtattttttagtagagacggagtttcaccacattaactaggctggtctcgaactcctaacttcaagtgatctgcccacctcggactcccaatgtactgggattacaggtgtgagccactatgcccagcctccacacccctactttctggtgccagttgttaaacatttacaggtacaccactgattttagcttttgcacattttaaattgttccactaggttcattagctctttgatcataggaatgctacacatttgtctttgccctctgtgttgttcaacatatacagtgggtgctcaacattttgccacttgataggagcctataaagaagcaaccatttcacaaagacagctttgctatgtgcttttaatctatctgaccttatgcagttaaaaatacctccacgcacacacaaaaaccttgcaggtctatcactgtttgagttgtaaacaatggggaaaatgccaaacatgaaaacagagtgaaaatattacaatgggatagtcgaagtgaatgcatactgacacatccttaccccctaacaaaaagctaagatcagtcgaattcatgtcacagggaactggtccaaaaaatcagcaatgtttcacctagagaaaagaaaaatgtaggtggcacagagggcaataaaaaagtatcttcaaatagctgaaaggctattacaaaaaaaaaaaagactaggtatgttctgtattgcactagacaataacaacaccagaatcaatgtttagatgttacagagagatacatctttatataatgaggaagaactgtcctacaaagatggcccaaggtccaatagtcaacctcaggaagtaggcaaattcctgctccagtagtactcaagtacaaggtgtggcatatagtagcaatttaacatttttacatgaatgaatgagtgaataggctggcagtgtttctcaaccgggactactaattcttcctaaaaggtgtttggaaatgcactgaggcacatagtgagaagcaaagatgttaaacaatgcagtgaaggatgtccccacacaagaaattaccaccacacaaaatgccaacagcatctctcttgagaaatattgagaaatactgagctagacaaatcctggagggaatgttttaaagatcaacattcaatcatgaagtaagtgtttattgagtgactggcaagtttcaagcacattgctaaaactttagggttaaaaggctgcacaagatagtttcttcttacaagaggctcgagactaatgggagagaaaaagtaaccagtttcaagagagtgaaaaatggctaatctagaaatctgaacaggcacggataggacagagggctcctctaactattggggtgtggggcagttcaaaggatagggaggcctctcagaggccttgaagttgggttttgtagaatacgtacaggaatttgccaagatggagtaagaaattccagagagagaaaacagtagggggttaaggaacagaagtgtgagaaaacatggtgctagaggtctgagaaagcaatccatgtagaaaagaattacttttgtcatacttacatttgggtaactggtatattttgtaaacactcccacacagagcatattatgagaacctaagcactgtttgagtgaaacttgagtatgggcactgctgaaaaaggagactggggagttgaggacatgttctttgcaaccctgggaatctgactttttagaggagaggggaagagttatgtctgggttaccataggatgagcagagaccaaggccctcatcttacaccactctcctccttctccctgctcactctgctccagcaacatgggcttgctttctgctgcttgagctcagagctaagcttattctcccaacaaagtatttgcatgtgctcttccctctccgtagaacactccttcccagccttgagatctcatttcagtagcacctcctcaaagaggccttctcttgtccacccaatctaaaatagcatcaactgaaatgttcacattctttcacttgattattgcttgtcttcacaactagagtgcaagttccatgaaagcaagactgccaaggccttgttacttgtatagtccagaactatgggtaccactagaccatttattcacacctggccatttcatcctatgacagataaggagaaaatggaccagaggagaacacacatgggatggttaggagactccacaccacagtctatgaagaagaagctactgtctggtccacctaaaaacctgaatgagaatagaaaaaacttggaaaccatgtgctttgggagaaaactgcagggcctgggatattcagccccagtaaaaagtactctcagatggtgcatcctcttttcatatgtctggaggtatcatgtggaaggaggactggaactgctctggatgacacaccaggtgaaagaccacaaggtagaagacaagtgagaaagtaagatttcagctccacatgaggaagaacagtaacaggcaaagtgacagtcgaaagttcacaagggcatttcagaaggttccaggttcccatcagcagaactgtttaagcagaagctggctaaccaatccaatagggttgaaaagctcaagccttaggttacagagcagacaaaataactaacatttgtatgtcactaactgcatgccgggagcaatcttcgaggtgcacgacaaatatgaactcatttaatccttacaacaacctgagaaggcaggtgcttctgtcatcattttacagcacagactaagacacagaagtcaaataacctgaccgagttcaccttgccaggaaatggcagagccagctttttaaatgacctttaatgtgtcctctaaatttcacagtaatttttttatgcctccactagcaatgagttgctatcctatttttatcatctccagggaaaaagctttccaaaatgtccaagtgtgactgtccagcaccatgggggctcagagtgtaggtggcacataacactgtacttcagtacttgcatagaacagtcattctgaaaagctgtgctgaatgagggacacagcccttggtgtagcacatatttctttatttttattgtctatatccccataaccttcagatccacaaggaaaaggattttttctgttatcgttgactgctatgttcccaagtgttaaataaatatttgttgaaaatagaaaagaaaggaaagaagagaaggaggaacaaagtcggtatcttcaaggattctccaccttggactcggcacattagcttctatgcgggccttttcatttgaacgtatcaagagaaaaaccactaggagcccagatctcagacaaactaaacatgtagcttttgtggttttcaagagaatccattgcaaacagtttggtttctaggttaaaagaaaaacaaaaacaagcatttttcaagcaaggtagctgaagcacagataaaagtttagagtacatctctgggttgctgtcaaaatccctttctgattaaatgtaataaaagagagtcaatactaaaatgttaataaaatgatgtttttcccctagtcgctagcatctaataaaggtgttttgatcctatttatgaaataaattatattacttagtacccaaaggtgtgattttgtctgtgggaggtaatcatattctaatttaatgacagagaggaaaaatcatgcatgactaaaatagctgtaacacaggctatccagctttaagaagacttacatcttgaaaggggctacagacatgccaatgcttgttaaagtattaaaattaacatgtttaaattttttcatttactatatattcagtgtgccttcttccagatcccataagcccacactatctttctcatgcatatttaatctttttttccctgggaagtcaactccacaaccacccctccagaaaaagaactgtaaacaaggctgaagggaaaagtgagacagggagatgaggcgagagcaatgcaaaaggacagatggctaagaaaagcagagcatcctagagtcaccctcaaaggaagagagagacaattagaaccagaagggagcagattcatttcggaggcatttaaggctctaatatcttccccaagcggagaaatgggttctattttgaggcaaaggggaggcttatgaatactttataatgtttgcattagacagcctatgtcagcatgaatagattgcatcctttgggtgagtaagccactccctggtcagtggttagaaattttaaatgtctttcctgaagcaaacttcctgggagcagttgagtcaccaactaaggtgatttagaggcagacagaaaacctttaatggaggaataatgaactactctgcatgcatccattaggccccaagagtataggaggcctcccaacagggttcagcagaaaaccattagtgcagccacattttgaactgtatgaagacaactggggaagaacctaaagcgtaaactctctcttcagccacaccaacatcattttctaccttaagctgggatggcatgactggtatgtgatttcgtaagaaaaaaggggtcagtatgatttattaaaattctaatcattcaatcaaaatttctggtgagaattcccttgtctaatacttgggcaaccataactaaggccatcctgctgtccaagcacatttttgtttcaagtgagtaaggcaagtgctgtgcctgagttatataggaaatacatgctttcctataagattgctaagggctaactaaattctaggcctaattaatttcattaaaatgacacttggtttgaaaaatattttagtttcacttctctcagaagtagatcaagaggtggatattagaatgcaagtgggaggtgatttggggcaactcctgcaaaaacatgagacaggaaaaaggaagtgagctaataaaaggttcattgtcaataaattaccacaatgggcaagtggcgcttaatctcactggggaattctaggaagcagcatggaaaatgtgcctcaaaacttaacccgcctgagagaggaagtatagtcatataccagctccccattatgggatgctgggggtgggaaaaaggccttaattgtccagcactttccaacctgctgcctgcctgagggtggaagagtgggtggtggttgagggagaaagccgagtgggtttcagcagccacggaaagcacgtaaggagaaagaagctggtgcttgcaccagaggtcaagcccagtgtgcactgaaatggcaggggtctagggcagcaagagcaactgctgctgcaggaagaaaagtcaaaaaggaagcaagcgccagtggactatagcgaactagaaaacatgggctttcagtgtcgcttgtagatactaacattcgttacaggcttcaatccaaccaaaaaaagttactcatatacccccagcagctgcagccacacaaccactaccaccacccagtgcccagaatgcttaggtggaagacaaagctggattgctctgcttaataaggggtgtggaacttaaagtgccctaagagaatcaaggaaagaggacagatgcctaggagcctgggtactgtgtgaaagttgaggaagaaaaaaaaaaaatcaccacccctactctccattctgctctaggaagaatagctatgtagaaaagactggagaaaagaaatctgtaacagacgatttttcatagtttcttgtttcttaatgtgagacacacatatgcacatacaataaacttcctctcccctctattcttaaaaaccttcagtgcaaactacattatccactaacactttggtaggaggtgattctagagtcactccgaaggttgccatgccctacatctgaggtgggcattgacaaggggacagtgcacttcctagctatatccctgttcagagcactttctaacataccagagctccacaacaagtcactcgttcgctgattcagtctcagatgtacattttggtgtttcccccaccgagatcccccattagatgttttaaaaattgagaccaacatgaaactctgacttctggggtaaaaactcccagcagttttaatatattgggataaccacatagctcttatcagttaaagagtatgtattaagattgccacaatccccaccactctttttgtttcccatacattacacttgcactgatttttcccaggaaatcctagcaaaaacgtgtctagcaaacatggaaaaaggaaaactactgctagccagagcactgcatgattctagaacaaaagagaatgtatacttctctgtggaaatgaagaacaatcctaagtctaatacaaaaagtgtgtgttgtgtttgaagtttctggagtccttgagactgacctttatgctcagaaaagattactctgatggcactttggttttaaatattaatatttgatttttcaggttataaatttaaaagtctaaaataaataaatttaaaagcctactttttccttcagcttacaaatataattctgtttataatctaggaaagtttagcaactgcttttaagggtacttagaggaatatttagcaccatttataaatagttaactaaacctcttcaaacatttttaaattcatttataaatttaatatatttgatttcctttaagtacttcaattgtctgactttaaaccttcctgggtaattaaataaatctctgaaatctaatgaattaaatttataaatatggtgaatcaaattcatttaaatattccagcactgtagatcaatttagtaatatttcaacctaaaaccataagcctaagtcaattacgcaattatgcattttatattggaattataaggctggtctgtttaacagaacaaattctcttaagcattacaaaaacttaaataccaaataaacacggattccttttttacacaaaagcatgttgtgttagttttgattctctcaaatactgctatatttaaagctttactcttttaactccctagttgaaagagatgatgacttcttttccaactaatgaacaccactgttgattttgaccaagtcattagagtcttcgcaaaattgatgggagatcatgagccctatttatagactatgtgacggacttcaaactaaagttggtggtcatgtaacttagttcctaagatttgagtcacattgtaaccaaactgcaaatgagattagagtttctaactgtcactcaggtagctataccacttggctggattctatagttcttccgctcctaaaatatataaatatctccccttttaaatctaaagacctgtgatataatggcagaatactcattctttttctgtatttcccaactctgccccaccctataatgtctgttatggacattaaaatgatattttccaaatggattcctgacatttcaaacagattttgtctatttggtcacgatgtccaagacagttctactgacagtgctatatggaaagaccacaccaagtcccctctacttatcagttcctggtaggtatctgctatgatcacctgtgagatacaccatactatgagtttggaaatccaaaggctgttaatgtatggatttcaggcaaactgtataagcactcaagttaaaaatgaaaggggatgcagggatgtattgtttaatgattcttaactttttggaggtcaccgacactttacagaatctgataaatgttatgaaccttctgcacaaaaacacacaaaccctgtagtttataatttccaggattttgtgtttcccctgacattcaccaacagataccacgttacaagaaacaacacaaaaccttggactagatggatctctaaggtccttttcccaacatggtcctgaaaacacaatccatcaaagtgacgcattacagaggaggtatcagaaatttgttttggaggattggttttcacaacgactaatatagagagctcatcataatcaaagcagaataaagttcaatggaaattaaacagactaaattttctttcttttccaaaattttctgtagtctgtcctaattttcattgacatgtatggcagaagtagggtagagtgaaaaagtaacctagaaggttagaaaagataattttattcagcttggagaaataacagtgaagaaaatctttatgatgggtattccaagtatgtaaagggcttttatacaatgcaagataataagcttattctccatcattactaaagataaaatataatttcaagataatagaacattttggggttttgtttggttggtttttggatgagttacttaagataaaaatggaaacaacttatctggaaatcacaacctccagtgttcctcatttgtctgggattattaagaactactaaacagcaagaggaaccacatgttttgtgaatgaatgaatatgaatgaatgacctcttaatattcctttcaaactggtaagtcgacatacttcattgcaaattatgtcgtttttctatttgtttaagcagttgtttcatctacacactctacgctatttactaaacagaaataatcctatttcatatcattgtattttttagagtctacattttatctgttaatatcaattctgttgagtttaaattccccattgatagcataagtttaaagaaagagttacagctacttaagagtctctttgggccctctatgtgctaaaagctaaaggcaaacttctaatatggttttaccttgtggagtatttttggaggtttagtgggttttgaaattattttatctgcagagccccccaacaaagccagggctcctgcactgaacacattcaatgcttgggtttaagctgcctggctcatagagtaacaaagaaaacaaagctctcatgcatgagtccgtcaacaaaagcaacacattttctttaaagtttcagttcaataaatgtttgccttacgggaaagatctttttgctttttgagactttttcctcaaatgctctcattttaaatcacgtttaaaaaaaaatgccttttttgttgttgctagagatgggactctccaaggtgcctacagcaacaatgaggttgtagtgaactgaaaggcaaaaggcttgaaatctatgaccttgggtaagcccttacaccggtatggtaagaggtaatgagagtaaggtatataaaaatgaatagacctaaaaccgtaaaaaccctagagggaaacctaggcaataccattcgggatataggcatgggcaaagacttcatgactaaagcaccaaaagcaatggcaacaaaagccaaaattgacaaatgggatctaattaaactcaagagcttctgcacagcaaaagaaactatcatcagagtgaacaagcaacctacagaatgggagaaaatttttgcaatctatccatctgacaaaagctaatattcagaatctacaagaaacttcaaaaaattcacaagaaaaaaacaaccccatcaaaaagtgggcaaaggatatgaacagacacttctcaaaagaagacatttatgtggccaacaaacatgtgaaaaaaagctcattatcactgttcatcagagaaatgcaaatcaaaaccacaatgagataccatctcacaccagtcagaatggcgatcattgaaaagtcagcaaacaacagatgctggagaggatgtggagaaataggaatgcttttacactgttggtgggactgtaaattagctcaaccattgtggacaagagtgtggtgattcctcaaggatctagaacgagaaataccatttgacccagcaatctcattactggatatatacccaaaagattataaatcattctactataaagacacatgcacatgtatgtttattgcagcactattcacaatagcaaagacttggaaccaacccaaatgcccatcaatgatagactggataaagaaaatgtggcacatatataccagggaatactatgcagccataaaaaaggatgagttcctatcctttgcagggacatagataaagctggaagccgttattctcagcaaactacacaggaacagaaaactaaataccgcatgttctcactcataagtgggacttgaataatgagactacatgaacatagggaggggaacatcacacactggggcctgtcgagggttgggggctgggggagggatagcattaggagaaatacctaatgtagatgatgagttgatgggtgcagcaaaccaccatggcacgtgtatacctgtgtaacaaacctgcacattctgctcatgtatcccagaacttaaagtgtatatatatatatatatatatatatatatatatatatatatatatatataaaaggatagacagtgagaatgcagagactaaatgtcttcaggagatgggcagctaccataaaaatgtgactttggagactgcatgcttcctctaatgccattcaaatctgaatttaaaaaaaaatcagcaaaaaagatgtacataaggtggattaaatccgagcattcagagtgaggtgtttttgtcccctccaacactcctcatctataaagaagttggcaaatctccatggatcttcgccttgtagaagaagtggcctagaagtaaaaataacttctatgaagttcctcagtgctgctataaccaaacctgtcaatatgttagtaaatgtttctattttgccctcactttccttagggccaagtcactgttttcaacaccgcatatttttcatagaacactccaattaccaattggggaaaaaaatgcttcatatttatgctgaactaaaacatgccatacactagaacttaaagtcagaatatgcaaatccctaaaataaagcaaaatgacaagtcaccacaggagatgtattttagtccaatcatatataaaatccagaaattatgctaagttggcaatcactaaaaaaggcatgtattcctctattcattcatccaattatccattcatttttaaaattcagtcatcatatactgcactcctattatgtgctaggcactgaggataaaaagatgaaagaaacagacacatctttcaaggggatactgcctggaatctgacaagagacatggtgttgatcataagacagtgtatgagaggactacagatgctgttctgagcaaagagaagggataccttgctcagataagggaggagatgggagctttaaaggtttcttgaataaagagttttaaatgataagcaggagatagttgggtaaaaagaagaatagtactttaaagctaatagttgtttttcacatgtaacaacaaaacacattcccagtatgtaaaagttttccgtgtcttttatatccatggaaaactcagatcagatctaaggatagcacacaaaattctctctgaagcccagggaaagttggcatgatttttcctaacacaagccctactgattcctctgatggcactggggacatacagtgcaaactccatgacatctcaaatacatggagcttggagaagacagcagttaaaatcccctctctttcccttgcgcgcatacacacacacacacacacacacacacacacacacacacggcagttaaaatcccctttccctggcgcgcgtacacacacacacacacacacacacacacactcttacgaaaagtcccagagtcttaaagacctatctgcaaaggaacattcaatggccctttcaaccagtgaactaaatttaaaagaaactatcttataaaaatagttataaatacacttaacaaagaagattaattcttgagactccttgcatattccaagtgagccagaggagctgtatcttcatccttcctccttgctgaagttacttttgttttcagctcactgaacttttatcagtactaattgggacattcttcccgccagggcttagcattttcagatgtttttgtaggtactgatttaatggcactgacattaaggtttctatccactgggtcacataaaagccaactagaacaggctgcaaaagaagcagagtgttgaatatcaaaaggagtgggtggtcaggaagaggactgtcaatgtgcttaccccgctggacagacatgatagctggtgctggctctagttattagcacagcatgttgaaggtctactgagagtttctattgagcctcctcctgatgggataaagctcaggaaggaggagaaggctacagtctatctttgattttgcagacactgaatcaaatattcccatctcggtaaaatagcagagacacatgtcaatctccaaatcagctttctgagcctttcttaaaaggttccgatcaatttggccaccctggtgaaacctgggcattgctataaaaaaattcagacccaaagaaagatgcagtactttgagggggagagagcagaggtatgaggtatggccaagagttgagttttttaagccagccttgaatcagttgctgcctaaattctgttggagccagacaagtatttgagggaagcaagcgtgggaagtacttagagaacagagaatcaggacaaagtggcaagtccaggccctatccaaagggcagccactattcaactctaacccaatgttttgccatgacagcatgcaggtctagtatggcaaatgtgatattttaagagaagtgaaaatacaaattttattgtgaaatctcccaattctgaaatgttggcaatgaaagtaaaagtcatccaggtcaaaaaatacacctggtgctagatgcagctgagcaaccactggtttatatcatctgatccaaattctaaagtaaaagtttgtaattcatctccatagcagaaagtaatagagatcctactagagcgtaggcacctgaactatgctactttttaagccagaagggccccaaggggcataccagctggccttggatataaacacgttatgttttcttctctcttctcaaagcaaacttaacattaggttcaaaatttccaaggaaaagaaataaaaagggaactgatgttgatattttgcctttcttttaaaggttttagagggcatatgggactagtaagtagtttgcatttgatctctacagtcagtcttatttattaaaataaacttgccggttcttatttattgaaatacgtttgccctgactctcagatgacttactttcacagatattaggactgaatgatctgagtctcctgttaaagtactgtagacaaaataagggttctttaacctggctttcctcagcatttcagggattgttaagagcaatttcattacacaaggacatcccaggtgaatttcctgatggtcaaaaggagttcagggctagaaattacatcataagtctgacaaaaggcttcacaaccacagggcctgcttcctcaaagtgggcagtcaacgggcaaggatggaaagtgctctgttctgggtaggcaggggcagcagccttcccttcttagaatctccagcaaatgcagagcatgggggtaagaagactgaaggagtggaggaggatggattcatgcactcattcaataaatatttatttaatgcctgctgtaagccaggtattgttctaggtgctgtgaatcaccgctaattaaagtttctaccaccattaaacaaaattctaaacagacacatattacaatgttggacagcacccagtgccatgggagaaaggagagaactaggaaggataaatgggccaatatgacagaataacaaggctgcttctgaaatgtttccctaaggcctcctcagagagcatttcctggataagaggagcgagaaacatcagtatactttggcattcatatcttggttccctatgcagaaaaaaagaacaccaatttgaaatccagtaaaattgactaaaacttgtattattaggccacctttaattccttatgtctcagtttcttcacctgtaaatggcaataatatcagctactcgtctcaaaggattaagtgtagattacacatggcaatgaaccaatgctctgtacagtgagctcagaacagaatcagcatggcgtgagccacatcgtgactttcactggtacctcgcagtgtctgcctccaagtagttactcagttccttttccctcctcatctcccttagagtgagggcacaaggtgggtaagaacttgcacatctgtgttccacagcagagatgctggggctgaaaagagctaaacagttcttttggaaccaaagtaagaagcagagttccgtattattagctcttttttctttttcctttccatacctatttcattcatttatttttgtagagatgggggtctcgctatgttgcccatgctggtctcaaactcgcagccttaagcaatcctgcctcagcctcctcagtagttggaattgtaggcatgtgccaccgtgcctggctcctttccacacatacagttaaaacgtatacattaatgaagaatcagcaacttttgaaagcatttgatggaccatattatttctttcagacaatgtttcatggtcaaaagaaacttgtttccataaaaaacactgaaaaaaatgaacagttttgttaaatagttgtgttttattccttctctcaaaaagtatggctataatgggatttcagattgatttatatgggttgataactgccaaaaagtcaaatgataaaattttccaatgcaaaaataataactctagtaaaatgaacaaaatactccaaacatatatttgatgaattgtgacaccagttaaatactgcctgccagatttttcaaaggttgttaaaaatgggtccctttagcaatgcaggtaagggaaaagtgagaaattgatttcaaattaaatttttaaactgcttttgccactgctggtgccacttcagtgctccttaggtgaagactcgatacctcctttgtgaggtggcagctgaggagattctggcacccactgaggccaatgaaaagcccaacgaaggaatgaagactcagaaccaccactgcattactttgaaggtggatgggcataatacatctggggtgtagtttaagcttaggtagtatacaccacttagtaaactaatgaaagcctattgtcattgaggcagatcaaattccaatcaataaaacaggcacacgtgcacagttaaatacaaggatgaagatacaactgatgtattccagcagcagacaggaggcgtctactaacaaatgaacctactacttaactccagaactcttttcctacagactaagaatacaatctcaactagaaaactctaattcggttttaccacatcctgactactacagcattctctgttctttcatttccctcttccctattcttttattgtatataaagtagcttgcgtatgtgcacaagcataatgctttttttttttaaactaaatggccaatggtattttttgatggtcatgaaatggagatgagatggggaaaaagtactggatctgtgaaaatgccccctttcttcattagttgcatgctcattcagctctcatttttatattccagtaaattattttgttctcaattttaacaataacaacaacaaaaacccttgcatatctttgattggctcacttggagaatttgaacgtttttcattcatcactggtaaaccaaagccaattttataacttttttgtatacagctgttatatatagggcaatgtctttaagtagggataaactactctaaaaaaatgaatcctcagtagtgttcccttcaagtcaagtgtcttgtttaaataaacttcttgtttaaaaataaataaataaattcacaaacttaatcccgcagctgcttacctacatttggccaaaaatgaatcaaattgatttttctcactcaccattacaaagagggtgtttgtttatctctggaaaaactacttctagaaagtctatttgagaagtgataaaagtagacaatcattactttatgaggaacaattaatttgtaaatgtgctatccagcatatatccagcatatctgcacacttattctaattttttcaaattaaatgtattaaaccagaaggtgaataaatcacattacaaaaattagtgtttctagacttaacatatctgtggagaaactatgtctggtaaactccatgcgatgtcataggcagaaggaaaacaagagcggagcatctttgactcgaaacaacgaaactacattgcaatatccgttttcaccatccgatacaaaaattacaggtcagatttgccttagaataactagataagtcctaggtacattttgaaaaccctttgttgattagtattccaacttttagcaatatccaatataagttcatgcaaatacaatcctttggaccactgaatttaacaatgtaacactcctcaccccaattctggaggtctcttgttctccttttttatccacagtgcatatcttactttttctatatgtacgtgtatatatgtatatactatgcctaatgtttatggcctgcttccttcaaaagactttaagatccacaagggcaggaatctgtattgtgttcagtgatatgtccagaacacttagaacagcgcctagcacaaagtaagctttcaataaatgtgttgcctggatgaaactaaatgcattacgccaggttattatttaaagcaacacaatgggtgggttttattggtcagatgagtttttctcccatttaaaattgtacatttattttctaattatgagcctactgctttcgctgccaggtgctcttaaagcaagttacacttgtggtaatgcaggtaaaataaaataaaataaaataaaaggtcattaaaccaccatgtgggtatgcgggtacaggagaaaaggggtcatgccaatggattttacatcctcataaccagtgatctcctgtttaatagctctaggccaacaacttaaaataccaatgtaccaaaatacttgcagtcacacaacctggcccagaaatcaaagcatgccattgcaacattaatgcaacgagcaggcttcctgcaggtaacaacctctaacctcagagcattcattaggtcatagtcacaattttatctatatttatgttcactttatttttctctttaaaggcaaaatgcaaaacacctatgctgaacactttcaagtataaatataattccaaggtacaaagttctccttcacatggatagccctttctctttcattttgagttgatcatcaaatcatctattttttccagtcttcttataaggaaacatgtaccaaagtctcacatattaaaagtgatcttctaatccgggctcatgtcatatcctaaggcatatcatatacgttcctgaatcctcagtttccttatatgttgaacagagccagtgccatgcagaatcgtcaaggttagagttgctgaacgcaaagtctaggctgtggttctagaatgtagcactgtggcataatatctattcagaaaataatctgcattttactaactgctttaagaagcaaaatcatgagcggcatttcttctgttataataatgtagccatgcccttgtcatctgagttctggggtcttacctgggggctaaaagggagcagaaggtagcaagggaagagggtggggttcctgccctcttacttctatccaggtttgggttaaattaacataaatggtttctttgatttgggagagggaagagttaaccttccttcacctgagaaggcaaatatgtgcccaagttgattttccaaataagactacatgatgcctggaagggatgaaccaaatccttccgcctagagccttgacaaatgattgctgtatataacttgcctttaaaatggaccatgttgatttcagtaagttgcctggtggtgaccaatgtagatcagaacaaacggcacatcccagaatgtcagaactgtgtaaggtctctggaaggcatgtaaaactctatgaagatccccacctcattagtatcggtcatctgtccactttggcatgtatgggtttagactcacatttaagttttgaataataagaaaatataacatccataaacccaaatgttatagaacaaattcatacccatcactcaaatggaagactcacactaattctatggagggtttttctctttaagtgtggggaagtaaagtgtcctcatttcattggagtgatatcacggcaacttcagtgctattctatcatgccttcaggccacagcacattctaacgtccaatctttgtgacaaagcactggaacacagtcaccagcctcctcaacagatgagctgcaactcccctgcaaagcaactaaccaaccattctaaattgaagtcatcaaagaaagttttctgcttaaaatgaacttcaaaaaggtgagtcactctttttcacagtcagcaagtttcctatgggtagaaagagagggaatgatcacttatgtttcagtgctgaaaatatgggctatgtctgtcttgatgccttttcaaaacaaaagtattttagtaactgcagccacagatatcaaaaggcactccccagggtcaccatcatcaccatagaaatgggcaacccttaggcgagaatgcattcatgtgccactcactgccctatgcactttgtaagcatcatctcatttactcctgaccacaacccactgatattattatcccatttttccagataaagaaattcagatttaaaggtgtcaactaggctactgaagaaataactagtaaataaaagaactcaggctccaggagtcaagttcttcacctcactggcattcctttggcatcctaaccataccatgtctgggtttctacgtctcagtcaggcctagcaaatctgagtcctcaatgagccctcctatcttttgctgtaatagcaaaagtgtaatagtggtagtggtgtaataccacttctgctagttacactgtaatcactaaatcttccatcttaggaggaaaacagaaaccacaccagatatcttaccagagagaatttgagataagaaattagttaaattggtgttgtggaactgaaaaagtaaacgaagaacactgaggcaatccaggcatcaaaaccagaagaagcaacaaccacccctagggaacgtaaggaggagacagggtaattagaatctggaagtttggaggaggaactctgcagagctgggcaccagacttctgaggagctgcccagctggtactgggtgtaccaaaatgaactggagactgaaaccaaccactgttgctagggtgaaaacaggaactgcaaatatataggaaggagcaaatgcttctcctctcctctagtctcccagtcttcttctggtgctcctataggcagaatctaaggacttgaagaaccagcttcaggaactcccagtccaaaaacaaagctaagtacagaagggtgagtttgaagttggagacaaagcttaagtactaattagcacaactcccattaggccaggtgtgctggtaaacagaatagacaggacaggctgaaggaactcatcaccaaacatcctgtcccctcgattgatggtgaagtgtgacccctaatgattcccaccaaaaagactcttcccatttgatctggtccccattgaatcacttcatgaggggaagaaaatcagtctggactgatgcccataatgtgtgaatattgtactgagaattttatcatgtgcatcctaatatttaatccttaaaaaacagtcagttatgccatcatgcagcacaggcattaggaacaaataccttgctatgcaaaatcacatggtaaaaaccacagggctcacaggaaaattggggctaggggtcactcataaagttttgttagtgacatagaggaacctaataaaaatagcacagttttacacatattagatgattaagaactacatatatgccacagtaagtatgtatggaacttcatgaaactttatcttgaaacaggctcaaagtttgcttgtgggagtgggtcgtcagtcgggctgcacttgagcctgggtaaaagagcaagatcctgccttcaaccaaccaaccaaccaaccaaccaaccaacaaaacaagaaaagaaaaagggcacactccttttctcggaccagcatgctattttctcatttaagatatatcacttgacagtatgatgttcaggcagcagaacctgagggcagttttcagtgcagttttaccaatgaccttttccaggtgggagcgtagtgccctgggacgaaatggctggtgatctcaagcttctttaggtccgtgtttaatgcagagctgctgaacaaaggaattcgtgcctgtctcgtactttgtcataagtgcatttctagatctgagtcatagtgatcctcaaaagatgtttgataatacttcaaacacatggaaatacatgtcccaacctctgtggtccagaaataaaacgtaatatgaattgctaagtttgttcttccatcctttgccacggtgatctttctaagtcagtaatgtcattcctatgcttaatttccttcagtggctccctatggcccaaaagataaaatccaagctccttagcatgaaggacagactcctcccagatgtagcacctatttacacatcaagcttcaactccagctaagcccctacctaagctatggtccagtcagctgaactatttgctttcccacacataatttcagagtcacataaatttactcacactgacccttaacctgaaatgcccatgtcctctatgcctgcctgctcaacaccaagccaccatttcgctcacagcctcctctgatagaaagttctttccagtctccttatctttccaggcagaatgaaccattttgtggggccccactgtaccctatgcttgctaactcctatcacagcactttgctgtacatatttgatcgaaggtcaactccccttaccccacctttaaaagacaaaaaacaaaaagccacaagctatctgagggtactggccatgccccagtaatctttgcatccctggcacctagctcattgcctggtaactaaatgtgtcatcaatgtttacagaatgaagcaatggctacattatcataacaggaaaagagtgcagtaatatagatcaagctgtacctttttttttctccatctgaaatctagaaaagaccctcagcgccactaaatacgtttcaatatagacaaaaaacctactgaattggtaaaggcaaggtgattaccaaatgtatcaagtgattttgccaagatgaagatggcttgggaacaccaaggtggaagattctcaagcacaagaaactcactggtactttgccttaaaagcatattgaattaaatacaggtagtaccaaagaagtggaaattatactacagaaaatactccttctggatgaatgattaagtgaggtatctggataagaagctatggagaaagactgctgctggtaataaacacttttttacagaatctgaggattaagaaaactcttgccctgtagtgtgagttcgacaaatgctgtttaaataaaagcaactaggctgagtgcagcggctcatgcctgtaatccctgcacttcgggagtctgaggtggatggatcacctgagaacgagagttggaaaccagcctggctaacatggcgaaatcccgtctctactaaaaatataaaaactaactgggtatggtggcacatgcctgtaatcctagctactagggaggctgaggcaggagaattgcttgtacctgggaggtgtgggaggtggatgttgcaatgagccaagatcacgccactgcactccagcgtgggtgatgatggagtgagactctgcctcaaaataaataaataaataaataaataaataaataaataaataaaataaaataaagcagctagtcatgctgtcccacattaaggccaacttaatcaaaataccataaaaagcgtgcagataccagatatgacactataactaacatggattgcttacctagagtttctggatctacattcttcaagtggtctcttctattccaaagtgactcactctttctgggcagcagtggcatgaatcattaatcatgtaacagtgtatacagtcccaaggtatattaggcatgatcctctcgaaaacacacattctaaaaaatctttccaacaaaagcctactttccctgccatttgggtagggcatttcttatcacaaaatagtgaattctgagaatcattttctgacagctcaataactaaaatgatacatgcaaatgtaaaggcaggtcatacttgtcctccttaggaaaaatggacacacggaagctctaagcctgttttaccaattgcctaaggaagactcccacagtacatctcacagtcacttcaaatcccacagtacatctcacagtcacttcaaactccttatgccccaaacacccttctttttcccacaaacgtgctgtcctggccaatggtacattttcctacaatggtatgatcagcagcctggttacatttaccagttaaaatcctcaaatcattcttcattcctatttctctcctctatcaccaaatctcatcatttctttctttaaaaacttggtgacacaccaaaaagatctcagccttcgcttgactatgttttagaaccacagcatacattaggtagtcagctattctccaaaattcatgccccctttctataatgtagagttgttgccaggaagtgactgcctactctgaagttctatttaccctacttgcaataaggtgtgctagtgaatgttaggccacagaatgtgagcagagatgatgtgtgccactttcaggccaggcccatgaaaaacttcctcatagagcccctatatgcttctcccttctctgctggccgtgatgaaatttggggtcttaagtgatggtggagccacgaaaggaagccgcttggattctggatcaccatgtgaagtaaagtatcctctgtccagcagcacccacgtttcactgatatgtgaagacataaatttcacgtactaattcactaaaatattgaagtgtgcttttttacagcaccaaaaaatcaggacaactagaaatatttaaggtttcagttaaaaccatctccatgagcatgatactgagggctatggaattgcccttgaccacaggaatctaaccccttaagagtattctaccgctttttgaaaaaaattgtaaccattatattgattaaaaatagccacaatttactcacctttccctatgtgccaggcagggatcttactgtgtgttgtatggatttttaaaaatcatatatatatatatatatatgattaatgattgatgcccctatatatatatatgattaatgactgatgccactatatatatatatgtatatatggtacacattgctactatgtctcattttgtaaaggggaaagcttagaggtaaaaggtgaaagcctaggttacacagttagaaagttacacagccaaagctcaagctcctctgtctttctccagagctcacgccccaccccttgttaccctgccttctctaaggaaaaaaggtaagcaagataagaatgtggtgtgatggctcttgctccagttaccacatgaaactgcattttacaatataaatgtaaatttattttctgccatacagaagaggcaacttggtattttaggtaacaacactgaagagttgtataagtctagcttcagggtttcccagcccaatggaggcagctggataaccaagatgcttttctgatgctcacctctgccttccccattccccaagtgcagcattcttcccttcaccccatgaggacctcacgtggatgcctcacacgttacatctgaccatctatgaccatctcttcattcaaccacccatttccaaatccagatttcggagttagcttttataatagcagtccctctctggagtgtggactaaatatcattaaattaaccatttcatcatcatcgattttctccctctcttcaacaaaatccagatgacagttagcttgtattgtgctttctaactatcgtgagaaatgtttcagatcccaaaataaatctaccataatgttttttgaaaattaattcatctttccataaactgccttgtttatgactgatcattttccaaattacatgctgatgggacacctattagtcacggactacaacttgtctgaccaactgttcctgacaaagcatttcccagcagacaacaggggagccaatttgtgaaacggtaaccagagatggtggaggtcacctcacagagagcactgacctcttaacccaagaagctctgctcaggtattttatgtgccaaccttggcacagaatgtaatttgttgggttaaaatgaagacaaagacaaattacgcacttctatgagagtgctgaatttttttttctattgctatggtaacactactccattgtaggagacggaaaagaaagagtgggccttaacaaataagctataaaatctgtcaatgatgtatcaaaaaggacttttaaaagatactcctttcaattatttcactgctagaaatttatccaagagcaatagtctgttaaatgtgcaaaatatgtacatatcggatgcttataacattttattaaagatacatgtccaacaattaaattatggtgtattcatacagtggaattccagaggacaggtatgagttaggatgtagatgaagacttattgatgtggatgcatgttcatcatgtgccattaagtcagtatgtgagttacaggatagtacatatcatttgattctgttataaacattacccagggaaaaatgtctgaagatatttacatcaacatactaatagcaggagttatttctagtgagagaaattttgggggtgattggaaatacttgccatgtgcttttctgtattttctatgatgatttttcatatctgtgtaatataaatagaaaaaatgcaactgtggctgattacactatttattcaaaaatatccactgccccttcttagtgaccctttcctggtgcctctttttatgggaggagtataatttttgtccccatagacatcaggcttaatgatgtgacgtactttgactcatgaaataaaaataaaatatgagcgaaagggacacgtacaactcccaacaaaaaccttgagacttatcatgtgcttccatcaattttttttttcctccaccctgagacaggcatgctctggataggagatgcttcttgagcctggacagcaaaaagatgtgaagcagattcgagctaacctgccgtagccaaaatacaggtaagaaagttatcttgcgttgccataagccactgagatatggggctgtttgttaccatgggataacacattctaagctgactaataaagcaaatctaccaccaccccccacaagaccaaactaggatttaaataattataacagtccctcagttatttccaattagtgctggtgttccatattaacttcagacctctctgctaccaatattttttaactggtatttatgggagagttcattgctcccagcctcccctgctttctttctgcctgcccacatcatctcagagtcacagtgattattcctttgcctttcatgactgtttcttttaggccttcctattctccctgtagtccatggacgactgctcattccatgtctgcatatggtggctatggccaatgatattacccttcaaccctctttttaatatttacttatctttaaaatgttatttttaatatatgctttttaaaatttaatttttaattaacaaataattgtatttatgtatacataaactatatgtatgtattatatgggtacactgtgatgtcttgatacatgtttacattatagaatgattaaatcaaactaattaataaatccatcacctcacacacttattttttgtgctaaaatatttaagacctactctttttcagcaattttgaaatttacgattatttaagtcacaaatcaatcttctttatacatcgttgtgggattcatgttccttaaagactattctccaatttaccaccactggtttcaagctccccagcccgttagcctagaattcaggaactgcttaattcttcaagctcactaccctcataacacaaactctcagcaccagccaaactgtttcattcattatttcctccgcatacctcacattcccagaattgaggctatcaagatgatggcagtagcctgaaccctccggagaatggttaaactggtggtagaaggaatcattcaatgagtgactgacatactgcaatacaggtagcacagccctgaggtacaagctgcaaagtagacaggctgacaagacatggtgatagtcgccaacaattcctcccatccctgaacacacaagacctttttcctttctcttagactctgggctggctttgtgacttgttttgaccaacaaaaatgcagtggaagtgatgaaagactttcaagaggttaagaaacctggcggctgcctctttcttagagccctgcagccaagctcaaaggaaagccagggcagactactgaaggatgagtggtcacatggagagaagccctgaaggatgtggccatctgggacttatctgctccagccaagtttccagctgaatgccacctgagtgactaagccaaaagtacatggaacagaataagtgctcagtcaccctgatcaacccagacttgggaggaaaaataaattatagttctctgtaataatttgtttcatagcaacagataactaagacaaagggtattctccttacttctgctcttaatacagtaccactcaagcctctagggggacagtggctatggatcccaaaagacagtactctcttggcacagtggtagtactggggtaccctgagatgactaaacaggcagtgaatttaaatggtggcaagagaagtaggagtgcacatgaagtgggagagcaaaatgatgatagaggccatatggtaagtattgccaataaactagtccataagatataaagagatgaaaacctaggaatggtagaagatcccagctgaaggtgtgggcaagagccagtacaatctgagttatagtttctgtggctctgtttgcacaagctaggaaggactcagaaagagtcaggtggcattaataacgcctaagtctattaccaccactcatatccgccacactgtggttatcaggaagggacataaatccatcatgggcagaaacacaaaactaccaacaatcagagcactgaagccgcaggtggcagaaactgccagttgatcatcaaactgatttcttcctgttcctgggcacacgatcagacgacattccccagcctctctagcagttggatgagtccatgtgactgagttccagccaacagaatatggatggaaatgatgaacaccacgtgccagcctgaccaggaaacactgccacactctcctgcttgcccagcaaccttggaaattacatgctgatggccatggagcctcaagacagaaagaccgaccatgagtctctgatctactgcttgcaggagagctgccacctaaaccagaactggtgaatgaaaaagtggtgtactactaagatttgggaatttatcttttatgcccttataatacatcctagctgtacatatggcagcactaagcatctatacctgaaaatattctttagagcaaagataccccacaagggtctccaggtgttttggaaaactataatatagtaatgaaaagtccgtagctatgttcaatattcaaaatgcctaaagaaaattctacatttaggtttccaggctaattaaaacatcaagcctctctgcttttggctgcgatgcatcacttgagctagcagcactggccaactcgtgccagtcaggagcctggagctgcagtatggccaaataaatatccctgtaaaatgcagcttgtttagtcaacaaaaatctctcattacatgaaataatagaagtgatacctggtggtacaaagatttggaatcactgctctcacataccatatcgatatagttgggtcccttcatgttatttttttccttaaggaaaatgggcatcataacaatgaacgattatataaaagcagattcaaaaattactaaggtatcaatggatattattttatctttctgaaagcaccaagaatagatctggctgacgctattaaccaattggatgactttgggcatgttatttaaatctttcagaacctaaatttcctcaatggtataagggggcttctttcatttgcctacggtggccctcaggcttgggggccaccagcactagcaggagtgcttgttaaagaagaccgctggggcccaccccacttccattcaccaggtctggagtggggtctaagaatttgcatttctaataagcactcaagtttaacaggtttctccagagaaagagaaccaactgggtgggtgggtggataggggtgtgtgtgtgtgtgcgtgtttgtgtgtgtgtgtgtgtgtgtaaagagaaaaagggagagaagggagagattgactgatttcaaggagttggctcccacaactgtgggcctcgcaagtttaacattttgcagggcaggccagtagggtggaattccagtaggagtcactgttccagtcttcagtctgaaggtaaactggaacggaattcctctcttctgggtttctcaatcttttctcctaaggctttcagctgattggatcaggcccaccagaattatggagagtaatctgctttactcgaagtctactgatttaaatatcaatgacatctaaaaaataactccatagcaacatctagactggtgtttgagtaaacaagtgggcataatggcccagtccaattgacacccaaaattgaacaccacatcaggtgctgctgaagtcctggtattcctgaaagccactgccctacaggacagcgatgaagatacataagccaagccaagtaaaatcatctagtagcaatgggcttttaaattataatggcctcttctactcctcttttcaggctattactttttttttttggagacagtttcactcttgtcgcccaggctggagtgcaatgacgtgatctcggctcactagaacgcgggctaatttttgtattttttagtagagatggggtttcaccgtgttggccaagctggtccggaactcctgacctcaggtaatccacccgccttggcctcccaaagtgctgggattacaggggtgactgggattacaggtgtgagccaccacgcccggcctcaggcttttacatttttaacccatcagagaaaccacacttttcactccccaaatatttgagagaatattcttgaaaagagaatgttaaaatgcatacctgtggctgcttcctaaattcgattacccaatttctggattacccccttgtttctatcaactgagccccttttctattccgtaagtataaaaaccaaaagtttaatgacattactgaagtcaccaaatctcagattcgacagaccaccgacactaaaacaaggttagtatggttttccacctatgcctacgatttctcaaaccttcatggatagaaacgtagaaacctcaatttcaaaattaatgctcatattctgaccaggcggttaataattacatgttacataaagggggtgaataattttgtatgttgcaaagttgtaaaatgatattaaaaatgctaatttatctaagagagttgtttcctactaggattacattcttgctttttttttttttttttaacacattttaaaaatctgcacttcacagcagttaggaagtatcagaatctggttctgatttaatcagatgagaagtaattcagcttcaggccataatgacacttggtgggagaggtcgggaggctttcacacatttaaaaaaaaaaaatacaaatctctttcactcttcccttgaactttcactctgcttgatactattcctagattttaattccaaattctcccaagggcagagaaaagccatctaatgtgttagaatgtaagatatctttaataaggttttcatgataccagattcaaataagccactgtttaaaaacttattttggcaagggtggcaataaaaatatttatatagagacatacatccacacacacctctatttactcatccatccacacacacacatccttttttgaccaaccaaactcttttcttaccaaaaacatttggataacccttatctaaattattattttacttcacaaattttgttccacagtttcttgttatagggattaggaaaaaaaaatcaatcagctggggggaactctagatttaagaagctccattattttggaaagtctctgatattttaatacgctgatacgtgctgcgacttttattaaaatgtgtgtgtgactgtgtgtattcactatttcccaaacttatttgttcatcaacttttgttccctgttcagtacatctctcaatatttaagttctattcaaacatgcaagaaaatagcttaaagatgtattcaggaagaatttacactaacagttgatggacttccattaaaagaagcatctgtaaatattacgctctgtttgtaaattcaggtcagtaaggctatgtcttcaaccgaggaagaaagtagagtctaagccttaacaacgactctgcttcttcagttttactgcatttgaaaaaacttgtttccctataataatgatgatggtgtttcaaatccgtctggacaaatggtataacaatagcttaacactctagggagacaacaaatgtcgtatgataaaagaacccaaaatatcaacactagtcctttctaggttaagattatgagttctttcttcttcacgctgttctgcattttgtaaattccctgaaatgagctataacttttctaatcagaaaataaatataagtatcattttaaaaggtagtctaatatattttcttaggggatatttcataacataaatagttacaatgccatgatttttatcgtcataaccaaccagagaatacagaaaacctagatcagaaattaaaactaaaatatgaaacatgtcccaaaagtgctaaccttgcctctgttttgtcatcatatatgagctgctcttcattaagaaaggagaatcttcactttcacaggaaatgtgcagcaaactactagagagctatgttttcacctaactagaacttggatgaggaaaaaaaagaaaaccattagcattatagccaataatttactttcagaacagtcatttatggaacagtttctaatatctgtggtaggctggataacaattacaacaaccccccctccccatccctggccccaaaacacacacacacacacacacacacacacacacacacacacacacacgatatccatgtcttaatttctggagtcagtgaatcttaccttatatgttaaaaaggattctgaagatacgattaaggatcatgagatggggagattatcttggattatctgggtgaactctagatatagtcaggtgtgttcttataatagggaagcagaaggcaacgtggtgacacaagagaaggcctgtggtcacagagactggagtgatgcagccacaagccaagaacttgggcagccaccagaagctggaagagggaaggaacagattctcccttagagactgtgagaagaatggcttccagggggaggtgtggttctgtgaaagcactgattttagcccagtggaaccacttcacaattctggcctccagaactgtgagggaattaatttcagttgttttaagccaccaagtttgtggtaatttgttacagaagccatagaaaaccaatgcaataccccagtcgcaagtaggcaagtggtcttgacttctgcaaggctggggagacagaccttctggctgattggatcttgaagacaatccccacctttggtgactattcctccaccctggtgcagggatgagcagggcactggcttgcaagctctgggtgcagttccttttagtcgcactgttgaagtgtgttaactaaatctgacagacgtgaatctggtcacgtgaatacctgggataatgtccgtttattattaaacacatcatttcctgagattcttagcttgatgtttaaaatcatctctcttgctaggaaattaataaaatatgcatctgacacaattatgtccacacctacaatcctgatgtcaaacaaaaagccccacaaatctagaaactagagaacgttgtatataagaaacaggtgagaaagaggcaactcactaagcttattgattaaactttgaaagaataaaacatatactgtgggaaacatcggcaattgaaggaacaattgctgtacttgtgaatcaaattcattccacttaagagctccatgatctccaagtagtaccagaattgaaaagaagttattgcatttaaaggtttaatttaaatttaggtccttcaacagcaagttcaatgatttatcatactgattgaattctaattctcttacaatgttgaaatctaaaaaaccatttccttcaaacactagtgccactgagaaacacacttatagaactccttaatcctccaaaaataatgtaacacatgcatcatttaattcaacgaggcagtgttattgtcatatagtgataaaattagtagttctatgccaaagaataccttgggcataggaggcatggtatttttttctggtagtcttccagaaaacctggcgtagcaaaatgacaaagtattgatggcttaatatcataaatatggaacgaattatatataacttactagaaaacagagtaacaatctaaataactcacgtttcttcaagagggacttaattccctttcctaatacctcactctataccacgctctacataaaagtggcttacatcacttgaacccaggagtttgagaccagcctggacaacacagggagaccctgctgctttttttgagagggagtctcgctctgttgcccaggctggagttgcattggagtgcagtggggcaatctcggctcactgcaagctccacctcccgggttcacgccattctcctgcctcagcctccccagcagctgggactacaggcgtctgccaccacacctggctaattttttttgtatttttagtagagacggggtttcactgtgttagccaggatggtctcgatctcctgacctcgtgatccgcccacctcggcctcccaaagtgctgggattacaggcgtgagccaccggggagaccccgtttctataaaaaatttaaaaattagccaggcatggtggcatgtacttgtggtcccaactacttgggaggctgaggcagggggactgcttaagcccaggaggtcaaggctgcagtatgatcgtgccactgcactccagcctgggtgacagagcaagagcacacatctaacaaaaaaaaaaattaaattaaaaagtatattactatctcagtgtaaagtaatgggaattcaaatctcaatgtcgattaatttcaaataaaggttgtggcagagacttgctagctgttcaaaacccgttttgtcttattcatgggtgcacagctagactagatttcccagcctcacttacagttagcgttgaactaagactgtggccaatcaaatgcaagtataataatgtgcattgtttcctggtctggcccatatgcccccaaagaaacaattctccacattccttacctttctctaccccagcctcaggagccatgtgttcaagaagaccggcagagccacaaaatggaaggagcctggaggaataaatatatttgattggcactgatttcttgcagtagctagcattagctttactatacattggttttgctttatttgttaacttatgtattgattcagttaaaacaaaaacacattgggtactcaaaacatgacagaaaacaaacaagtgactcaccctgaaaattcagcaagtaaaggaaacaatgtaactagacaaaaatccaatgatgcacagtcctgagtcctacgaatgaaatgtgtacagagttctggaagtttttgtggaaatgggagaatgaagctagcttaagttgattcttgaagtacagacaaggcaggggcgtttccaaacacaggaataagctcacgcaaaagccgcaaggtgtccgatgattgtgggccctgtggggatgcagtggtggcaagaagtaagggacggggctccatgtacaggcaggggagccgtaactgcaggcttggtactctcagcaacacccttcacacactagtaccactgcccaataatgttaataccactgcccaacaatgttagtacctttgctggggagactggactttattccgaaggcatttcctgaatggaaaatcacagtctggtaggcacagacagagttaaaactgtgatttgagaaaaacatccacgtaccaggtagagaatacacttttccccttaagggatgtggtagttaaggaaggcaaagaaccagtaataggtagattaagtttacaagttactggattattacatctcaaatccaaggttttgtacagatgacttttaacccaccttctaaaatatacccagggtaatcgtttccaaaaacgacatattcagttaggcaaattactcctttacaaatctagacacttcatcactttttatacatccctattagacattaatcacagagtatttctatctcatgtctctttttaaattcatattgaaggagagaagaaaaaacgaacagaaaggacaacaaatacagagttaatatcgcatctatccagagcttagctgtcaagcaacgatacgcaggagaaccatccaaaaagtgaaaaggtctctgacaggtgaagacagttgtcacactggctagtgactaaagatgtggcaattttcccataggaaaagctctcaaaaccttattttgatagtcaaaatcatgtgaaaatccctcaaaaccttattttgataaagctgtatagaaaaggtaagtatccaggtttttaaaaaattaagacttttttagagcagttttaggtttacagcgaaaatgtgtagaaagtatatatactcctccttcccaccctgatatatgcagttttccctactattaacctcttgcattaatgtggtatattttgaaaattcgtgtacgactatggatatatgattaacttaagtccattgtttacattaggattaactgtgttgcacatgctacgggttttgacaaatgcataatgtcatgtagctacctttaatgtcatacagaacagttccaccaccctaaaaatcccttgactaccaattcatctctctgttcctctcaccccctgccactctggaaatcactgatgtttttattgtctctatatagttttgccgtttccagaatgtcatatagatggaatcatatagcatatagccttttcacaatggtttctttcacttagtagtatgccagttccatgtcttctcatgactggatggctcgtttcttaccacgaagagtactctattgcatggatgtaccatagtgtccccattcaactattaaaggacatcgtgattgcttccaattttggccgatgatgaataaagctgctataacattcacatgcaggtttttgcgtggatgtaagttttcattttggtaaataactaaaagcttgattgctgggttgcatgtttagctttctaaagaaaccgccgaactgtcttccaaagtggctgtagcattttacgttcctaccagcaatgaatgagagtttccattgctttacattctcacccgcatttggtatgatgagcgtgtgaattttagtcattctaatagatgtctagtggtatttcactgttgttttaatttacagttccctaacatatctcaagcatcttttcatataattattttcatttgcatatatcatttggtattcagatcttttgcccattttaattgggttttcttattgttgaattttaacaggtttttaaatacattttgcttaatagccctttatcagataatggggttttgtaaagattttctccaagtctgtggcttttcttctcattctctaacggcgtcttttgcagaacaaaagttttaaattttaataatatccagtttatcaacttctttttcccatggatcatgctttttgttgttgtatctaaaaagtcatcaccaaacccaggattgcctatattttatcctaggttatcttctaggggctttataagtttaggttttacatttagggctataatctactttgagctaatttttgtgaaaggtataaggtctgtatctagagtcactattttgcaaaaatattcagttgttccagaaccatctgttagcaagactgtcccttctccaataaattgcctttgctcttttgtcaaagatcagttgacaatatttgtgtgggtctctagtgtctctattctgctccactactctatttgtctgttctttcaccaataccatgctgtcttaattactgcagttttacaataagtcttaaagtcaggtagtgactgactgttaataagaaaggggaaaaaacactcaccatagaaaggtacatggtaactcattaaatatatctatctggagagaaaagaagcacctagaagtcgaggctgctctgtcagcctggatgcatcccagagtgaagacacagcaaggcagggtactttgggcataggaggcatggtatttttttctggtagactttcagaaaacctggctttgcaaaatgacaaagtactgatgacttaatatcataaatatggaacgaattatatataacttactagaaaacagagtaacaatctaaatagctcactttcatctctaatgaatcggatgaatgccattttaagccaatgaggtttgggtttttgtttgtttgttactataacttagcctatctcagccatgacatcctgatctggaaataatttcaattactttaatgaaggaatgtcacttttgatctccaaatccttcatcaagaacagaacaaataagcatcagcaatgctcctataagtgtagccatgtaacattagacatggtagttttaagaaataagaagtaaaaccttgggctttggaagataaagatagggcttttagatagtaattatttagaagttaaagggcatctgcatccaggcaacagcttttagtttgaacttcatttaggcagggactcttactacctgagagagtagaatataacttctcacactactgtagggaggctgaagcatggacaggaaatcagagcagagggcaggcagagctgcgatacaacaccaagacagcaatttgctgacaatcagtgatgaggtgcatgcatttgtgaagaaaactggatgcaaatcactagtgagcaactaaacagactctgtacttgaagaaaattttggccactttcattagaagagactgagaaacccatgcaaagaaggtaacagattccaggacagacttgaggggaggaacaaaatagttcaggacacacgggacaatcagcagaacatcaaaggggcaagtagactggcctgaagggaatggtgtaccccaccagatcctttgtgaaaaacagctaaaagttaataccacatcccatactctgaactgtgcaattattgtgaatattcacatttcaatacacaggccacattttcaacaataatagagtaggcattggcaaaccagggtgtcagtccaaatctggctgctaattgtaaatgaagtttttctggagcactgccacacccacttgtttatgtattatctgtctgtttcagcactataagagagctgagtagttacaacagaggccaatggcttgcaaagcccaaggaatttacaatctggctctttagacagaaaagggttgctgcctcctgacctagagagtatggatttagtcattcaataaaaccttttgttgtctttgagaaacttaaagttttagaacacgcttctactacctttattttaaaggccctatctgtccaccaatgtcaatattcttgtatctgtaagaaatttaaaaaattacagagtgagttaatggaggaaagcttctgggatgctggtcttactctgttcctgatctggaggcccgggacatgggaatttccagtgtgaaaactcatcaagctatatacacttatgtgcacttttctgggtttttggggtatatatgtatactgtgcttcaataacatttttttaaaaagcatgtattacctcatcccttatagaatttcaataggcagcatgtatcaactacctctcacagactggactccacactaagtactgaaatgaagatacataaagcgtacagttacagagctcggcagagtagacggtcaatatatataaaagcacacaaataactatatactgtcaagtatgtaagctgcaggattcaactacaagctcgtaacaatctaactaaactagctcaggcaaaagggaaactcattggctcagagattccaagcaagtgttatagcaaactgggaacagagaagcatctaggccagtggttctcaagttaagatgatttttgccccgcaggggatacttggtaatgtctgaagacaattctggttgtcactactgggggagagctagtggcgtctagtggtaaaggccaggtatagtgttagataccctacaatgcccatgacaacccctgacaacaaagaatagtttggctcaaaatgtcaacattgccgaggttgagaaaccttgatctgagtgttactataagtgtggtctgtcgaaacagcagcttttagcagcatcttaaagtagatcaaaaattcagaattgtggccctaccccagataatttaaatcagaatgtgcataagatcccaggtatcccttgagcacatgaaggtttgagaagcaggaccctcagctcctaccacatctggagtcaggtaatgactttgccaggcatgtttctccctgcgtgacttctcatctcttgctgtagatgagattttgcctcacgcaggaatgttggctgctataggttactaagattcacgcctcgtatctccccctccatgcaagcggtgctgacttgcttctcaggtgctgagtttaccaaattttaggtggcttttataggtaccaaggaaaataatgggggtactataataaatctacctggatttgggatcaggaaagccaacgctgaaaaatttaagctgatttctgaaaaacaacgacagttggcaagcaaattaaggcgtttgtcaaatatttactaagcacttactatgttccagacgctgttctggacctaggaatgtatcaatgaaaaggacaaagccctgatcctacccttgaggagtttatattccactgggcagaagcagacaaacacataaacaaagagaaagcacaatacagttgcagaacctgataaatgctgccagggagggaagcaggcaaagcatctggagaataaaggatgatgtgacagaacacctagggcccaaggacaaatatgttaggaaggactctccaaatgacgttaagatttggactgagacctgaagaaggagttagccaagcaaccaggagaacggtattctacaaagacagatcggcacaggaaaaggccctgaggagtgagagctccacaagctccagcctaagggcagggttgagggggtgggggcagcaaagaaggggaaagctgaaggtgcaggacgagggaaacagggtcctagcggttagttgtaaaacagaccttcagcaggagagtgcagtggttccaactgaggcggctcctggctctggctgcctcagtttgaatctgggatttgccatttataagaagcgtgacaaggccaggcacagtggctcacatctgtaatcccagcactttgtgaggccaaggcaggtggatcacttgaggcaaggagttcgagaccagcctggccaacacggtgaaaccctgtctctattaaaaatacaaaaattagctgggtgtggtggcgcatgcctgtagtcccagctacttgggaggctgaggcaggagaatcccttgaatccccaggaggcgggggttgcagtgagccaagattgtgccactgcaccccagcctgggcgggcaacagagtgagaacctgcttcaaaaaaaaaaaaaaaaagtgtgactatttcttagggttgtgaaaattataagtaaatgtcaagacaccctacaacaggagtcagcccaatctggcccactgcatgtcttgtatggcctgtgacctaaggaagttttctgtttacattcttaaatggttacgttttaaatgggcgtataagtacctacttcatacccttgattctgccccttaactccacaaagcctaaaatattgactatgtggccctttacaataaagtctgccatagccaagcctgtacacggtaggtgctcaggacgtgagggccaacactgccagctaccatgtcaacggatatgactccctggccaggcattacctgaggctttttacattatacttccccaaataaccattatcctaatttatagttaaaatgcaagcaagtaacatggaacatagaattttaattctagaattaaaacccaggtcactatgtcccaaaaacccatgatctttcagtctctcatgaaaatcacacagttaagccctctattaattcgtcctccaagctaggtattgttatcccctgtgtatctgatgccattatagcttttgatagctgagatagtgtaagtaggacccaggctttcacttctgaagccacttttgaagccagaaatgggaggtttcccagtgcagctcttaacgttggcgcatgcaaagattctctcttgggctcagtgaaagacagtcaagatgaaactgaatgaatttgtatcacagtgctcattgtatgaccaaagcaaagagaggattggggataagaaaagggtgtagctgatattgagggtggtacttaaaccaatttactgtccctctttttgcttttattcccccaatattctctagtaaatgttactttggtaataagagaaaatacttatttttataaagaaagaaagcagaaataatcagccttacccagagtagctacattgtactttttaaagacagcactattttgacagccaaaaaagacacttaggaatacagcattacaaattcaagatcatgtctatgaacttggcttgaaaaaaaaaccctccgctaaaatacaacctaccatctgtacaatgtattcaaaaatgattagcatagtatgaaaaaataatgctggaacagcagatttttttttttccattttttaagaacgcttcctgctcggtattattttcagattcctccatgaggtataagcaaaggcaaaatggaatctcaggtcaagaagatggaaacagaaagtaaacagagacaaaaaaggaacattaaatactctttactgaagatgtgacactgctctagaaatttcactgagcccaagagagaatctttgcatgcgccaacgtcaagagctgcactgggaaacctcccatttctggcttcaaaagtgaaagcctgggtcctacttacactatctcagctatcaaaagctataatggcatttctctgacagcaggactctcacactctcatgtcactaaaagtgaatcagcagagcttgcagatgcatggagcccagaaaggcacctctcagaagagggtgtggagagcgccggggcagcgtggagcacgatgatggccacagacagcagtatcttgccctgactttctcactaaccagggtgcctttttgcagaatctctcgactcctgaaatccttactaaaaataagggagttaggctgagaagccctgtctaaaagccattctatgcttctgtgatcttaaatcatgaggtcattttcacgtttgtgtaaatacatcctaacaaagtgaaacccctacagtatgttttgggaaattgtatccaacaataaatgttcagaatttttccccaaatgaacaaaaaattgagtatcaaatttatacctattagagaatatttaccacattggcagagtgcctcaaaggacttaggaatgttctatttgcatctgaaaggcaggttgcatgagttttgctcctatctcgtcagtcagcactagaggatgcctggggatgggcttctgcttgtaagaaaacttgtccacacaagaggtgatcaagagagtgacctccagctgcctaccgcatacagatgcttggtgcctgacacagaacttcatctccagggcctgaagagctgaatcaagccaggagacaatccctggagaatttaaataaaaaaaaaaaggtgaggtatgagctactgccagcactgctttccttacttccttctcatactctgcccctctactctcagggtacacaagccctcaaacttgttttccctccaacagggcccaggtggtaccttccaagacagaggaaacctgtggaaaccctagcataataggaggctttgttcatgatcattgccgatcacctctacactatctgcaattttagaaaacgccttaattggctgctggcaaggtcaaggctctaaggctggcaaacaaagtgctcgtttaataagttggctttcttcgctctacagagaaaagacagataaattcacacgtgggacagcatccttgccaagaggtatctaagggttagatgtgctggacatgtaaacactagcatgtttttccatagagtgctaaataaactagcacagaggtcagcaaactttctctgtaaaggaccagatgataaatattttaggttttgtgggccatatggtctctgtcacaactactccactctgctgttctagggcaaaagcagttatagaaaatacataaatgaatgagcatggctgtgttcccataaaagtatttatggacactgaaatttgaatttcatgtaatttttgcaggtcaaaaaatactcttgatttttctcaaccatttaaaaacataaagataattcttagctcgaaggccatataaaaacaggagtctgtagtttgatgactcctgactgagaggatgagacaactcatattctgcatcttaccacagaaaatgcaaagtgcagagtctttcttcacaagctcggttatactcaatttatccctttcccttcccaaatccaatcctccaaaatattcctccaatggggtccactgtctccatttcctttgtctctgctcccatcatctctcccatggcctccacctcatctggacaataatcttaccttcaaagcagtcaccacccaccagagtgaagggctttgaagagaaatcatcactccttaaactccttcaatagtcaacagcccaccccccaaatataatcagaatcaactctataatctgtgccaagccttgcaaggccctgcctctctaactttgtaatcctctccttgtctttgactctatgtgatggttcactgtatgtgtcaacttgactgccttaagagatgcccagatatttggtaaaacattattctgaatgtgtctatgagggtgtttctggatgagactaacatttgaatcagcagactgagtaaagcagattgccctctgtgttagtcagggctttccagagaaagagaaccagtaagatggagattatacatataaaatatgtgtatgtctgtaatgagataaggaatgggctcacatgattacagaggctaacaagtcccacaagtggtgcaaatgacaatctgaaggcctgaaacccaggggtgctaatgctgtaagtcccagtacaaggaaagaagactaatgtctccactcaagcagtcagattaatgttcttgtgccattttgttccagtcaggccatcagtgggttggatgatacccaccctacaatggggagggtaatttgctctcagtccaattacaatgacaatctcttccagaaacagcctcacagatacacccagaaataatgtttaactaggtatctgggcatctcttacattagcccaactgacacataaaactaaccaatacacactccctaatgtggatgagcccatcagttgaagccctgaatagaacacaaaggttggccctctagtcaacaggagaaaactccttctgcctgactccgcctgcctgactgcctttgaactacgacattgactttttcctcccttcagacatgaacattggctccttctgggtctcaagctctcatgcttctcaagcctttggactcatattattaatacaccattggctgtccggggtctggagcttgcagactcaccttgcagatcttgagatttgcccacctccataatcgtgtgaaccaattccttataataaagtcctttatacataaaaacacaaaaatgttttatatatatggtatatatctagatagatatgtatctcctattggttctatttctctgtgtaaccctaacacaaccatgaactgtcacatcatttttctcaaacttcttcaaacacattagggcctttgtatgtttcctttttcacaaatgtttattactatgttgttaccttctcattcaagtctcaatttcaatatctcctgccctaatattctttgaaaaatggcttcctctcacccttcaccaatgattctctacctcagcctcttatttttgttcccttcaaaacccttatcaaatctataattatttttattacttactcatgcctgtcttccctgaatggaaggtaaccttcatgagggtaggcaccacatctgtgttattcactgtatcctggagccctagggcagagcctgtcacagcaacttttaatcaatgttgcagaataaagaatagcccagagtttacagtccctgtcctcttctttggaacttccatccactttatcagataatgacctttgcatgaacaagatgatgctggtgatgataaagacccccctgtaccctcccccagtaaagtgatgcttgctcccctataccactgtgaagtcctctgccatctttatgctattcttactctctggactcatcactgaaatgaggacttactctcacaggggctgtgccttactacttaactgggtattcacactggtgattcaggttaacagttaagtcaccacctcatgtgacgcacagcagggacttttccccaccaccaacaccaggctacatgcagcttgaagctctgggtactatgataagtctcatgggtttgctcaatgaactgacttatccattccagttcctctgcggcacctaaatcagaataaccctgggtaacaatggtggatcagtggtggggataaacattaatgggtacaacctttaacaagagtctatgcttagaaatggaggatttgagggctaatcggcttcacctttccctaataaaaattatttttgtactattattcatagctacctttggctggttccacccaatcagtgcttgctatctgttcctcacactggacccatgaggagagctcttatttccacatagcacggaaagcaaagtgaaagcaggacaggaattcactgattggtctgtggtcagttcgtgaagctgatgagcttctcactgctgttgttccactggtgctctgattctctcctgcttcacaaaaggcaacaggaggaacatctttaactcaggtagaacaatctgatcttggtgcatgccaccacctaattgaagataaaataacctgtcagcactagttacgtgaatttgtctctatatacctcaaagtccccaaatgaggccaatcacagttatctgaaacctgccagcaagccagggaactgggtcctgggaaatctttcttgactatatctgctgtatcacaggaaactatgtagaaccttaaaagatcttcagactgtatatgcctgggatgatactctgctcacccagttcctgactgcataaaatgtgactggagtgtgaactatgttcatttcctgtacaacagtttttcttaccaagtaaaaagtcccctcatacctgctctactgaaaaaggcttaatccttttcacttcgccaatgtgaatttcatgctgtaatgggccaagttttggaaaaacaaagcagttgttttatacctgcccaactttctgttcacacaggtgaacaggactatcagtggtgaaatctcgccaacatctctcgtaaaagatccttgatttaacaatgactgacatctgcgcactttcccgttgactataattctcttcacaaggccacaccttgcggaacaaactttaaaagagcaaccagtgctaaactgcaggcattcttctttcctagctccagacatccctatctaggctgtttatttttcagctttctaatataatgttgggttgatatgtctgtcatatgacagcaagaaaaccaattacatgagtcacgctctaaagtgatcaaatgctggccagtgaagccacagctgcttttgattcattagaaatacattttccagccctgcatttttaccaggcaatgtagttcagctggtattgcagtttttatataatacttctttatttgattcaaagtacatatttgtaagatattgctaaaaagtcacaaagggaaggagggcattaattgtgcatctcctaaagctttatttccacaatatgtggtaagtgctagaaatgaagaaatgtctcaatttgcctgaaaacctccaacatggctttctaataagtaagactacagggtaaatgcattcctcagcatttgactagtgaagactcccacagctgctaagattaggtttctagcaggacttcccactctctcctcaattgcatgagtgaaaaatacaatggtctcagcttgattccaactatactttatttcctgaactgacactttggttttctttaggatagagctgtttagagtcaattgtagcaataaaaaataatgacaacgtcatgaatattcttactgaaaagctgctgcaccttgtttaggcactgaatatactgtcagtctgttcaaaaatagaggatcacaacagctgactgatgtagcaagaaatgtctatcttaacaatcagaaaaggtggtcattttccaaagtgaattcatcatgtggatagtaaaaaaaaaaaaaaaaaaaaaaaaaaaaaaattctatgaccaaataagtacacggtgtagagttaaataaaagttaaatgggttacttttccacatttctgagcttttaatactctgacatgtattatgaatttaaaataatttcttattgaatttttcttataaagtgcaacagtttgtagggctagtcttccacagagctttttgaatcttcggaataggccacttaaaagtgtctgaaatattttactgtctttcctacctctctctgacactcatacacacactattccacctatcatatggatattttatataatgccatgtattttatatgcttctatgtatattacaacatagtaaagcacaatgagcatgtttcacaatgctttttggcataattactatgtttcctacctggatgatatttcaggcaattctggtaagggcctttttcttcaaaacacaaggtgatttaaccaaagcatgagtgaacaaaaagaggggatacacagaagtgtgattgccacatctgttagcagtgcatttggtaagccttcccctgtcactatatatattcagaaataatgacaaaaaaatgtagttcctctgggcaaatgaaacggaggtgcaaattagaatcacacctccagtctcattttggtatcacttcttgtctggataaacaacacttactctcactctcctactcatggcaagtagccactgttaacacttgcattagggatcagtcacaacaaattacagttaagtttcacaccacactgcaggaggcagcctgggcccaggagagcataagagcaaagctgggccgcaggaccaattttgagaaaactagcgttggggctgaaaaggcccctgtgcctcagccacatgaagtggttaaaattctaatactctaagtggtatcttaatatttctgtgtgtagtgattcattattctctgtggagagtaatagtaggtagctgcttgcaaaaagggtgattttgatcaccaatcactttcaagaacacaagagatcagtggtactcaactgtgaaagcttcattataatgggaaactgcctgtgtggattaaaaacacaaacagatttcacttcaagatgattgtgtgagatgctaaatttccatgatgtgaaaagtatctacagactatgagccacataaaagtatccatggggaagatgagaaaaatcaggactagagacccagttcatacatgaattttccctacctacttgtggggcagaagataaaaggagctttgtaagctgtaagttggctagtttattgtttatccaagtagggcaaagtccacttttttgagtgaaatacaaaggtgaaatctgaataagagtttatagaatgcatacaattaatctccactaaataacaagaagtaaaataaaatcataaacctttaagaaacagggaggggcatggtggctcgtgcctgtaatcccagtgctttgggaagccgaggtaggaggattgcttgagcacccaggagttcaaggctgcaatgagctatgatcatgccactgcaacccagcaccccagcttggatgacagagcaagacctcgtctttttttttttttttttttttttaaagattcagcataaatgtgagaaataagtagagctaaacagtctttaagtgaagcaaatacacatgaattcattcactatcagacttgctccttttggaggcatattacttactagggcacctctacgaagttttctgagggatcctgacatctcaagatgagggagaaatcagggtgctttgtgatactgagccaggtggtcttctgagatcggggaacaggatttgtttgataatttagtaaattaaggtgggaggtattttttaatgtccttcaacaccaagtaaaacatgattgggtttatgatgattgtagttctcttttccataaacttcttgttgatatgatttaggtatctgccagcacctccagaagtagagaaaaatcattagaatgtatcatttccatgtcccctcatccatacactctgggacatccattagtataggtgtcctttgtgatttatgagaaattcttatgggaagggctccttgtaacccaatatccacacattgctattataataactctcaataatggcatctgtcatgtgccaaacatgacactaagtactggatatgcatcattatctaccccttcacaacaaatttctaaggtaggttttatcatgttcattttacaaatgagcaagttgaggctcaaagatgtaaattaagttgttccaggtaacagtgccaagaagtaaacaggacagatttaatcctgggtggtttaattctaataaacatctgtgcatgcttttattgagaaactactaggtataatgagaaaaacaggcacaaataatcaagacatatgtggtcaacgtgtcagaagtgtgacccactaaccatgatacaggcactacaacagattttagaccaacagggaaggattcagaaggtggtatttgaagtaaagcttggcggagagaaaaaggttcccttttctcattaaaatcctactctcccttccagattcatcagggattcctaagtgcaaaaaggacatttatgatgaagaaaaaaatgtaacggggtggaaaatgaagctcacatttatgacacgcaaactgcctaggttggctgaggttaagcatgtgaaaggaaccgtgtaaggtaaaactagaaagacgagattgagctagttttgcaagcaagaattctttggaattgtattaaaccttttcgacatcactgacaaactccatcaacatctatacttgcattttcttgcaagtctcttcattccagttccataggcattttcctttcctcttacttggcttactccaaagtcacttaatatcctagtcctcttccatctctcgagttttccttcaaatacagctcaaactaagtcactactcctcatctgcaaacctgccctgacattgaacattcatgcacctctaacttggtcccacgccttctctaccaagttctggctcctattcatatctgtgagccttgcctctcactattccctgccttgtccctaactctagttaaaagaactactggaaagttcttaactctcatatattctttcttacctctgagcctttacacaggaccacctctgcacatggcatgcctctccttgctcttcacatgtgcccagctaattcccccttatctctgagtatcagttgatacgttacgtctgtcaggaagatatgtcttgtctctcctcacatctaaggtgagctcctttgctttctacacaccctgatctactcatactcaccattcagtattgcaaatgcttttctacttgtctttctcacttattatcttaagcagctactgagctactgagcgtcattaaatcctgcaatctcacacatgaaaaaatgaactattttccataacaggccaatactactgaattcactcatatattactcatttttcacaactcttcttcaaattctgaagaaaaatactaaagatgaaaactgtatcttcacataattttttcccctctcttccatttatttcctcttcttagagatacctacaccttagatattggccccttcgagggcttaataaacatccatcagtatgagagtgcaataagtgagtcaacttaatatacaaataagtacgacgagcgactgctccatggaccattttcatgagactattacataaatttcattaacctcagttggtaccgagaagcacacagtccactggactaatatgggagaaaataagtcagtattcatccctctatgtcactgcatttcctcacattctctgttattcattcagtcttctctgttgtttgagactaaattctcccagtgaagacaagctctcgagtgtgtttgatgcttccacatatctccaacaatgagaggtttaagtggggacgcaactagtcacccagttgttgactcatccaatcaaagaaaattaactgataaaacatttataatgttaatattgccctccaatcacctggtaaagaggttagtgcctctccctgccacatattcctgaacacaaatccaaaggcaaatactagacatatcaaacaaggcatgcgcctctttaaactgggcagataaaagcagaactttcaggtgggcacaattagcaccctcccaagggagaatagagagaggggaaatgatgcaaaataatgcagaaacacttaactggtattcacattctagcttgcaaacaatttctaattcacttgcctagacagttaaccatcagtctggatgtaaagaattcaaactcaaccaagaaacaggaagcataagttctgtcacaagtgtgtttattttggtggctcacatctgcagctttttccccctcaatgtatttttttcagagccaaacgaggaagggaacaaagttactgggcctaaatccatcactgtgattgtgatatgctgaaccacccacagcatcatgagaaggaagctattagtttcatgctgaagaactccaacccacataggggcagaatctagaagtaaaggaacagtctattcagcatgattaactttattcagtacacccaacaatgtctaagaactgatctagtcacactcgatttaaaagcagcattatctaaggggatgtgttccgatggatgttccaaggtacctggtgttccactgggagtccagcatcagcatgagatcttttggtgtcatcttgcgttgataacgttactgctaaatcactacaactgcgaatagagactgaacactgtgtaggtgcagggctaaactatcttaaaccaaacttacaaaaccaaagggtgcagacttcacaacagcagccttgtcaactgcatcgcatgaatccaaatccttggatgggaaaatctcctatacagattgagttcttgtaatccagagaaagggtcagcaaactacggcctgcaggccaattcctgccagccactttttttgtaaataaagttttactggaacacagccacaataactcatttaaatattatctactgctgcttttgtgctacagtggaagagctgggtagttgtatagagatcatatggtccgcaaagcttaaaatattacctggctctttacagaaaaattttgccaatccctggtctagaatggtggagcattcactaattcttgctctgcaaaacctggttctaggtcaaaattattttgtcttgatgctgtaattcctcactgaagatcctagtacttaaggccttgggttggcccacagacatcccaaccctctgcttggaaacactataggaacaggtccaggtggcaaccctgcaaatctgaacagatgcctatttttcttctgcccatgagacagatggtcctcagagagggggagaagaattagtccatgagagagaattctctgtgcagcactaattttggaaatgtatccctgatccatctggccaaagaggattccttaggagtacctttgctattcgggtttgctgaacattcaggaggggaatcctaagctccaaggctagaacctcaggtatttgctctctatcaaaatgttaagtaaagccctttagacaagaagtctcaaataattatgacagaagatgattataaggatgaagacaaggatagctgactactcattcagggactccttttcagagaatttcttcaatttcccttggcagtaaattttcccttagatgaaaaagataataccctgatattctgctatgtacagaaagcaggaagaacaatactttctgaactgctaacaagagtagctctcctctagatataacaatgtttctccttctcattaaccaccttaactcatctttgatattcagaccttgttattctaaagaatatttccccgcggaacaaaccataaatttgcaaagttaattaggactctgatcttaacgcatttccccccatttcattcctaacgctctgccgggggtgtccaagggagaggaatacagccgtgggttcttggtttctgtttctggttgagccaataaagcctcttcctcatccctcttttccgcttatcactagagacataatagaaaaactatataaaaatagaaggaatgtcttaaactccttttcccttttataattagttggcagagagacatttaaagtgtgcatatacttcaggaagacaccatataaatatgatttttatctaggtatgacatggcttcaggctgctaaaagcctaaaacaaaacaaagcaaaacaaaacaaaacagaaacaacaacaaaaacaaaataaggcgggttggacaagattgctagtatagcaggagtgtccagtattttggcttccctgggccacactggaagaagaagaattgtcttgcgttacaataaaatatactaacactaatgatagctaatgagcttaaaaaaaaaaaatcgcgcaaaaaaaaaaaaaaaatctcacgttttaagaatgtttatggatttgtgttgggctgcattcaaagccatcctgggctgcaagcggccccacaggttggacaagctcgccgtagagggttggttctgttcagctccaggtaggaaagagacaatattaagatcagacataaggggaaagttaggcaactagaagtagaggcattaagaaaagcaactgctaacagattctgatcattcaatcttagccaacaggcttttgaagtatgatggacttgggtgtaagtgaaagagttgagtagttgtatagagaacatacggaactaccacttactacctggataatctcagagtcctcatctataaaacaaaataataacgtagttactggtgctgttattgtgaggattgaatgaaaaatgcatataagtcatttaatagtgcctgagtcacaacatagtaagtccttaataggtacctaacaatcattactgagcaaagttcctgctaaaagaatagttgctgttagaagcagaaacaaaggtggagcacagaagaagtcacaagggaaaaatatctttcttgattttcttctgagtcatatacttggagaaaaaggaaaattcttagtgcttttggtcccaaaaccctgtgtagcgttacctgtgagcctgacaagatccttcatccagtttcaacatcaaggggaaagaagatgctgcttcacataatgcaggtctctgcagacgatgctgtgccacaggaatcaatcaagaaatagttacatccccagcattgctccgtgggttgtaaaataaatgtttcttagacaaagaaagtataagtagctgaaacattaggaaaataatatcactgatcctaacacggtgaagtacttggcttaaattcagccttacaaggttttcttaagaatatactattggtttacaaaatttaactcagtatttttctaaaattgtaacaccttctacgtgaggtccccagacacaggcacaagttgtaggaacagagaccatggcaaataataaaccaggaaaaccagagttgacttcatgataaccagggtgggaacaaaattgacataggtctctataaatgaaaaccaatacttgatttgtaactagaagcaaatgggcacccaggacagacaacacaacacagctgcgatgacttccagccactgataatctcataaagctcacctccgtggcaactccctgaaagcaaatcaagatcaaccccgctcctctcggcagatgcttctttttccaagttccatgggtttaggttacatctgagctcactttcacgcatgttgcgagctaattacaaagaatccagaaatgtgggaacaaactgggaatactgtaggctgtttcagcaaaccttagcaccatctgctgaaatattaagatgcttgtttaaaaagttggctgtcagagaaggaggtcacagcacagacagtggggaagttctcttaaataactacttcttacttctctttcctgtatacaagctgtagggcactgagccaaaggtgaaccgtccagagaaagaagaccgtatctgctaacttctcctggtccacgtgccagcaggagagaacctagagcatgctggtcatcaaaagagaagagatacggtcaaaagactgtagcatgtttgtgcatttcagtgagcaacaacagtcatttgggaaaacagaatggaacgtcttaaactccttttcccttttataattagttggcagagagacatttaaagtgggcatacacttaaggaagacagcatataaatatgattttatccaggtatgacaatcccttagtaatctgagacttgtgagatttggggattccctttgtaggttagatgtttctctcagaaacagagcagctgaaaagagcctcaggtgtgtagacagtgatcaagtcaatggttagagttccaacgggcttagggaaaacaaaagaaagccttgcatcatttaatgtgttgaaaggccccaacagaatcacatattaataataataacagcagcagctaacatctttcgagcatgtaccaagcattatgttaatggttacatctgttatttattaagtcttccagcattctcaggtaggtactgttgtctcatattatagaggaagaataaagatgctttcagaaattaaagaacttacaagagctcatcagtttggaacggataaagctgttattgaagcttagctgctgactccagggactaatttcacttgtaactatgaaactatattgaccatggactgagattcatgtaaggccgctcacacaagggagtgtcatcataaggatatgagtggtaaagtggaagacaaggataagagcccaaaaacatgcttcagggagacaataagtggagccaaagtaactagaaggatgccaggcagcacaagttcatgggtcttcactcctgtgtatcactattactgacacagctactctgcctacctgctttcccttctattaacttgtttctgttctctgtaactggtccaagtcactcattgtctaggctacagattggttgtcggctgagttaggtagcaatggttcaattaactgaggccaggtacaagagcaggggcctcaagggctgctgagggccccaacttcagctgaagttatgggaaaggcagatacctatggaaggagccataagaacagtgggccccatgctgctcatgtagtacagaaagcaattctgcatccatgtttgtaatctgcctcacattttttggcttttacagagattgtttatatccaaaagggcacacgggattacttttcagtcccagcagtctatgtgtagtgactacatggatacaatagtatatacatacgtgaagatctttcctactaataagtacaaagagtactaacaaagacaggttacttatggaagggtttcctcttccttcttcactctgtttgtttcaaagtcctgtttattagaattaaaaggtgcatggtcctgatttccacttaccaggaggctggtcatttttcatcattacgtagaggggtggctcccagtttagctcaaccatctgtcgtccctcgcaagcctgagagattcacagcaggaccagtagagtttgccaaccctctcaagcaggctctgagggcagggttgacaagttacttcccaagcctgggtggaccagacaggaagaacagatccatacatatgactagacagagccagacacgcagggataataggtcatcataaaagcaaagttggcctccagaaagaagaaaacccaccctgcgacaatcactatcaaaaccacaggtattcacacaggatacttccatcgaactccaaatgtctctagagcaaagaggttaaaaatgttcttgtggtaagtaaaacctccttttcatgcaaacaaaaattaatcacataaacattacatggtgacataagccaaaagatcaacaaagctttacagtaagtaggatcaatccactgaaaagaataattaatgttcaaataagcagggcattcatttttttttccctaagaaaattaaactctgaagatatgggttactgaatatcattagatcagaacctaactattaacacacttcatccaggtggtgctcagctccacacagcttcctgctggagtcagcttagaaaggatgacgggggagtgaaagtaaaggcgcagttttcggccctttttatgaaatgttacaatcctgaaatattccacttaacttctccaggctcttttaaatgcacttctaacaaactggtaggacaggtgtgagaaagtatatgaggctcggagtcaccaggagcgagtttacactcgctcccaagttctgccatttactagcctttgttacatccagcaagtccttcagttctcttgagattcagattcttaccttctcaccccaatcccaatgagcatcttagcacctgccctatctatcacgagattctgcagatcaaattaaaacgtatattcacagctttacaaccctgaagtagtcatcaggcattttcatttttaatggtggcatggactcaaatctcttttacccagctttcaataaaacagggtacatggtgagaatgggttccagaggccaggttaaaaccccaaatttaaatcttagctctctaaataaatcttggcaatctacttacactcttgtttcctcagctgtaaaagcggaagacacaactcattttgtagaactatgaggtgctgcacacgaggcggggctaacaatggatactaaatgaaatactggttttcttcttctaatcctgtggtgccttccaactaaatcttctgtaattatccaatggctttgtggtattatatcttaatatataatatacaatgttcaaaatgaacacaaaactgaagatatccaaccttttcaattcttatattgttccaaaaagcacacctttataaactgaaacaaaagaaatttacaggcagtaaagctttaaaaatcctgacacgtgtcatataggaacgtgctctcttagcagttactttatattatctataaatgacttactttttattacaggagataagtgaaaattaagggcaaatgaacaaaacttcacatacccaggctttacccaaaattctaaaaagtagagtttgctaaggattgcacccaccacaagtaatgaagcaacttttttcccttctattaagacataccaagtacttgatgccatccagagaagataaataatggtttaaacattacaggaaaaagatcctttagaaaaacttacttttggggtatttttcctgtgccactgctatattaagactttacaacacaaacaagaatacgtatcaactcaaaagaattttcattttgacaagaacacaaacatacctattgaaactcatccaatatccaaatcctcctgtttcctcagtcttacagatttagcagtcttacaacggtgagggccagtacttcctgaccacactgatcaaccgaactgtttgcaacccctcaaaggtacccgtgctctcagcgtataaacacataaaaacaccttaaggcaaagtaggaggtggccaagccttggctgctcaagaactgccctaaatcaattttaaaaggaaaaacgaaatggccatgtcaaccgccgggttctgatatgtgttggctgtacttggctagagaaatgatggaagttatcaaaattcttagaaagaagtagcatttagaaaagcagagatgtgcaatttgttttttcttttccatggacaaagacagtaaagcccctagccaacccattaaatggttaactggaaacagttcgcatattattcctctggcctatttctctctacacagattttcacctctagtaaccacagaacagttttttccatcaaccatagtcctttgcagagtaacttttaacaaataaatgtggaactactgtagactccacctccagcccttagtaaaagtaaccagaattggttgcaaaggatctgctacagtttgaatgtcccctccaaatctcatgttgaaactcaattgccattgtgacaatataataggtagacccattagggagtgattaggcattgacagctctgccctcatgaatgaattaatgccgttatcacaggagtgagttccagatgaaaagcaagtttggccttctctgcccttgttctcacattctcttgccctctagctttccaccatgggacgatgcaacaagaaggccctacccaaatgctggtgtcatgctcttggacttcccagcttccgcaaccaagataccaataaatttctgttcattataagttacccagtctgtatatacctaaaggaatataaatcattctattataaagatgcatgcacacgtatattcattgcagcattattcacaatagcaaaggcatggaatcaacccaattgtcgatcaatgatagactggataaagaaaaatgaagacacacacaccatgaaatactatgcagccataaaaaggaatgagatcatatcctttgtagggacaaggatggaactggaaggcattatccacaacaaattaatgcaggaacagaaaactaaacattgcacattctcacttgtaagtgggagctgagcaatgtgaacaaatatacacagggaggggaacaacacacactggggcctgtgtagggggagggagagtatcaggaaaaatagctaatgcatgctgggcttagataggtacagcaaatcatcgtgggacacgtttacctgtgtaacaaacctgtatatcctggatatgtatcccagagcttaaaataaaatttaaaaagaagttgcccagtctgtggtactcagttatagcagcacaaaatggactaagacacaatcttaaactaattgagttcaaccacctaaacgacacttggaatatcccagccctggaagacatccaaccaaagctgcaagatgtccagggaaaagacaactcccaatgcacataccccaggcctatgaaatcactttttgggcccaggaatctatgtatacatgtttcaacaagccctctgggtcaatcttaagaatgctcaagttcaagaaacactgccttacatcacttcttctcaaacttaaatatgcgaatggatcaacctgggacttctgttaagatgcagattatggctcagtcgtttaggggtagaagctattataaagtaagtttgcatttcttacaaatttccaaaagacatcaatgctgctgatccatgggccataattagaacaacaagaccttgagaacagagtccaggtcttattctatgtactataataatttattagcaatctactttggcaaccaagattatgtcatgttgaaggtgatatggtggtaagtagttggaacactgtgtgaaatactgcacattttatttcaggcaagtccatatccttcatgtttatgcacgtcaatttagatagcaagtgctactgtaaaatgtatttgaatacttttaggtattatttcactcatatgatactactcagtttctaaataatagcttggtacatagaggtctgtggttctaatcacacagagtgctcaacattggtcaagtcaatcacttttcctttaccagagttccttacctgccaaatgaaggcatttgcatcaactaatccacaaggcttattactccttatgggtccaacagcatgcatgaacaacaggaaacagcaaaaacagaaatacccataactgctaccgaggtaattttctacacatacaaagcagttaagataattgcctatcttgccaccaaaagaacaaatgttttgtctctgaagacagaaaaataaagattttaatcaaagattttaatctgaactgggttccattaaagcttgcaagctttcttacctgttagaggctcacataccgcaagacaaaagggaaataatctgggttctactccaaaaagtctgactctgaccatgctttagtcaggatacatgctttcgtctttttcactcacttacctagaaacagataactcatctttccatcttattctgtgacgatgaaagaagctaaaccctaacccctaaccccttattccattagggaatatgtatctttcagaattacgaaaattagtaatcaggtcatggtctacattcagcaaaggaaagcaataatgacaagacagttttatataagagtctgatactaagtcagagaaatatctgcccaagtacacccaagaactccacatgcatgtaacctcctgatattgttgtatgtctcttaggatttggcttttggtgaataagtggcattagtcaagctatcaactctaagtagaggatattctactactaatagtaaattcaagcaggtcaggttaccttttggctattaacaccataatattaccatcaaaaagaggaaagttatgaagtcttgtatttataagtgtacgctaaataccactcacctggtctcttaagaaatagaacatcagacatttcaacgtttctttacattcgtctgatttttctgatacacacacacacacacacacacagagagagagagacacacacacacacacacacacttcagacacaggaccagtttatatattgtccaagatggaagacgttataattaactgtttatatcactaactttatataagaaacattcacacttacaagatgttcttatccaaggagaacagaaacaacacacaacaaagtttactgagtgtgtacacttgcactttcttttgaaacatagtaattccttttccctacttttcctggagtcactgttttataatttaggcattattttcaaccctgacacaccctcgaaacaagcaaatccaaaatgtaaaaagaaaacaaaccaaaaaaaaccaaaaccaaaaaacaaaaaacccacaacgaatattatcagcactaatattttgatagagaaaataacattttagaatgagccaggcctcacaccctaactgtgagtaggtaataactcctcagacttcactctccccttttatgtatcctgcatgcattctgagtgctcacaatgctcaaggaactgtggtggatacagaggaaaagaaacaccaagctgacctgcaggaaaggtactactctaagggattttccagtctaggaagctaaaacatgagctaagttatgtatgtattatagacttcccctcacacaaaaagcccagctaggcttttttccaggtgatgtatttcagcagtaaaaccaaaccacctcacttaagggtaaaatgtttctatcaaggccacctactattaaccattacagtatactgtgttaagactgcaggttttgaagtcacacgagttgcagatctagcttaacaatttgctaattacagtccttggacgagtttttaaacctctttcagtctcatcttattcctctgtcaaattggattagagtatctctctcataatgttaagcgagataatgcacagaaaatacttagcatggtgcttgactcaaatcatttcgtcaaatataagttttctgggtgtcaactagtatagaaatagacaaccacagggttcctggaccctgaagagaacacaacagaggaggaggaggaacgagcagagcaagaacacctcagatttcctataccctttccagctaactccaaccactaatgtgtctctgccttggctgaaaaagccctgtctgttataaaggctgtctgggatttaccctagagccactgaatcagaatccagttgtgtctgaagcatctgtattaataagttccaaaggtgagttaccatgcatacctaagtttgagagccacagtgcaagataaaatgctttacaagtgtttcaatatttgttgcgacatgattcaactaagatctgatgttttactctgagcccaatacagctgtctacagtcttcaaaatctcaggatcactgtccaaaatgtcactcagaaatcttcctaatggaattcttcctgatttacctccactccttgcccagggctcctgcccattgtgtgggaaagaagagcatgacacagaggtgccctcactgatccatcttgctctgaggtctggtcaacccatctatcctcactcacagctccacatccttctcatctcacttttccatatctctaatgggtccttaactaatttattcaagatgatgttaccacattgctttcaaacactgagtattaaaatcaagtctgagtattaaaaaacattgtctaatagacacactccaattctaatgattttggtgccctagtatatattggcttggtttccaaacagataaaatataaattgtcttaaagaaacaaaaaaatccatcaacaattcacactacgataattatttaatcttcattagaaggaaaaagggaagaaagtcttgcatttgctgaaatttgcatgtggtcaattcaaaacacaaatactgtaggagactacagaattatttaaaaatcgttatccagagaaagataaaaaatatttacagaaaaagtttcattaaaattactagataaattaccagataaaatataccagcatttatacctctccaattgtatgaaaatttctattacagggaggtgtgattaaagaactacactacttgacttagtaatagatctaagctggctactcaaacagattgccatctggtcactcaattgccatttgaaaagctgctctaaaaatatcttcatataagtgcgtaaatctcatcaaaatgtaatgacttctaattaatttatgctagctagcaggaaacaaaatttcaatgtacacttgagattcccacttataatacaattaccaaaaccctccaagattcccaaattatttccccaaaaagagacacggttaacatctcctgattccacttactatgaagccactataaactagtcctacaattagggcaatctctaccagccttttaaatgtaggggagtccatcaatttgctttagctacagaatacacaaaatacgcattttcttatttccacaaaatggcaacagtacacaaaagtaagcgggtgctgctatttaccaactctaagattatgtacacttctgtaaaatgggaacaatacagaattctctgcctcacaggttgtgagaatcagagagaaaatgtatgtaaaagcatactgtttcccagggcctagcaaaaggaccaagtctccagaaccctgatgacaaagggtaatacaccaaaatatggactcgttttccactccaccttcactggccaagcagctgccaggaataaaggtcgcatctcccaatacctggcaaacaaatgcagtattgcctcgcaaatcgactgcttcgctgaggtgctcatgagcatatttggggagaagcttcaagaacaagttgaagagagactgtctttctatgagactggagagatcctatcaaagaaaatggatgtcatgaaaacagaaatggttcaggcagagaaaacggctgctgagattattaggaagctggagaaacaggagtagaaacacttaaacaaggaaaagaaatgctagctgcacttgccgtcccatctttggaaaacagaactccagaggagtgtgcaaagacaagtgtaaaacccaaaaagaagaaaaagcaaaagccccaggaggctcctcaggagaatggaatcaaagacccatctaactctttctccaaacctaataaaaggaaatctttttccaaggagaaattggttagcagccatcgagaagagaccgctggcagcatcagtcttcccaacaggaagacgtcttcacccaaggaggaagcagttaatgatcccaaagaggcaggcaacaggagtgtcactaagaaaaaaacaggaaattccccttcaaagaggaaggagctggtcagcagtggacctgaagaggctgctggcagcaagagcagctccaagaagaagaaaaagttacataaagtaccccaggaagatgagagtgcaaacggacgtcccccgtcaggcggggcacatcctaccccaaggcgacatttcccattccgtgtcctacaccccaataaaaaattctcacacacgaagcatattgtgaatcctaaggcagtatgattatggatatgcacagaaatatacactccttcaccaaaatgatattcacaggcagaagtacagacactagaaaaatactgaaacaactccttcatttgagctgctgtttctgaagtgtcagccattaaactggagccaagattctctaagaagatactctttccaaaagacataaatcaatgggcaccagattgtatctgtgaatctctctcatgcgtgcacatgcagattatctcacaaaagctccaacaagtccaaagcagcaaacaagaagtaaacacaaaaggaaaaattcctgagaaaacagcataatgttttgagatgagtcacatccaggtttgcatggggaggattcaggaaaaggaacagtacatgctctttctgcacatgcagccacagccatcctggcttgcacaaaacagcaaggtgtttaagtgactctgatcaacacagcatgctgatgatcccattgtacatttgatttggctcaggatcgcccaatcgaatttgctaacacagtagactccagaagaatcacccattaacaacaatccaaatacagcctctaaatgtgcataaggccttttgtgatctccactggagcttatagtatctaacagctgcaactgtgactgttctagctaattgctctcagcaacaaaaataaacaatcgcttcaggaaggagactgtatccaccaaatattaatgaatttttaaaatcagaaatctcaaatcttggtttaaaaatcttgctactgctaaaaagtctgaaacagagttaaggaggccctgaaagtccttattttgtagttaattcgcccctcccacccacctaaccccctcccccacagttaaaaaaaaaaaaaaggaaaaaggaatgtggcttgggtttggaagaatttaagcaatctgagatattttaactcatgtataactttttaacatatgggggaaaagagtcgcactgattggagctatttttaaagtgcagctctaccataaaaatagacatttactcataaggatgcttgaatagagaacaagcccaatctacgtctcattgttaagaaaggggtgaaaaaaggctgtcgtgctttctggagagccgtttatggtccgcctgtgatgtcatggcaggatccaggtgcactctaacgagcagctttcagtctcatcaattcctttaaaagtgctcttctaccatcagctagttctctgagcacaagcaataaggagccagtatttacccagacccttgcaagacagaacatcaccgcaatcacagacccaggaaggaggaggaaaaattactcacacacaattgggttcatcgtcgtcctctcctcctgtccccattagggatggaagcattttcttttgctaagaaaagaaggacagaagtagttatcagtaccctatgacatctactcaccctctgtccgtagagagaaaaagtagcttcatacttctctccctatccatgaccctactgcatagctgatgcttgcgaccaaattacccaccgaacacagtagcaagtagtcatttaggcatcactaccctaaactgaggtttggagagatcatcttagcgtctggacttcatctgtctttagcctttttaaaaggctggagactcatgcctgtaatcccagcactttgggaggctgaggcgggcggatcgtgaggtcaggagtttgagaccagcctggccaacatggtgaaaccctgtctctattaaaaacataaaaacaaacaaacaaacaaacaaaactgggcgtggtggcaaatgcctgtaatcccagctattcaagaggctaaggcagaacaatctcttgaacccaggaggcggaggttgcagtgagcagagatggtgccactgcactccagccttccagcctgggcgatagggcgggactccgtctcaaaaaaaaaaaaaaaaagcctggagaaatacagttgtaataggaaaccacatagaactcctgatttttacacctccctgacataatgtcagcaacaatcaatgtaacaaaaaacagacaacagctttgacatgtcttaaaaatcagaaatacgttattttatctcaaaaaatattattcatatacgcatagaacacaattaaaaaagcaaaaaaactttattaaagaaaaaagcaaatctgaacgtttaaaaatgttgtagaaaggattaaaaataaagaggcagcgacaaaatgtactaaaaaatgttttctttccatgaaaggactgagtaaattttgacctgaatttttttgtactttatgcattttcgacagtgactatactattattgactgaaattattcttaagggaggtaaacgatattgagcacatcaaaaaatactatatgcacttacctatgttcaacttctagatgccatacatatcctgaaggatttcaaaaatctgacctcctaaaaggacacagcttattaaagttaattcagcttgtgttttagtactttgatggtaggaaggacagagctccaagagtgggggagggctgggtttcagtgccaggtctcaggttagcaaaaaatcttggagaaccttaatctctctgggtctggctcatacatctgcaaaataaggtgtgctgaacaagaccactgaagtgtcttccaactcaaaaccagactgagaaatagaacatagattaagtcttcagcctaaatcttacagcatagtgactggtacagcgtagatgcttgatgtacacttagtgaaagaaaggaaattttaaaaaagtaaactatttaaatcagagcttcccacacataagccctggtgtgctgcttggcctagaagtggttgtacgtgtgtggagataaaggttccccctcaggacaggcactcatgacataaacgagcttgggaagcacaacttttaaaatgtactactatttcagcaaaaaataaaataaattttcattattaggatgaggataagtttcagactaaatttatgaaaagttcttaccaccctttatgtaggaaagaccgaatgcttggcttatcatctggtcctcaggccatcttaagacagaaaacataagtagcagtttacttaagcaaagaggacttctttatgcaatgtatgaatagaacacaggtacttctttaagagtaacccctgaaaaacagaatacattcaacatatagttctctacatacagaaaacacactgcagcaaccattctcaagagatgaaatttctactaaagaacatttcataaagtaacaactgcaatttctgcttcagcatttctagtaatatctgcttaacctttctgatagtcacccaggttttttttttcttggtgtgaaaatctgcattatttcttataattactactacacctaaggcataacaaaacatttttaaagaaatagatgatctacaacatggatgtaaaagtacggggattttctttcaacaaggtgctcaatggtacttcctgatgggctgctttttttcttcaaggtccaaggaatgaagcactgcatcttttggatgcctacatagatttatgggtcatgacctccctcccccattctcatggccagctgctgcacctttgccacactgcaattaaaaacccgcaatccagataacaaaactaccttgccaactgtgtttcattccaaagagtgagtcaccctgagaatggctgctggtctcatcatgtctgcaagaaaatccgcagatgggcgggttgtttctgaagcatgcattcaacaggacgaggagcattctcaaaaggagtacaccatgaaaatcagcattagaggtagcatgtggctatcaacaacctgtaggtcaaagggccttacaggattaaaaaaacccagcaaggttcatcattgaaatggttattgagtttccaaacaccaaaaaaaaaaaaaaaaaaaaaaaagggcatcctatcaaactaaaacctcatcttgcatatatctgagaagtatttgaattttataatttttccctcaccttcgatgaaggtgatgcttgagtgatacaggtaagaagagtgtaaaattcatatccaagaaaggaatgaatcaggtactgtaacactagaaatagtataaatcctaaaaaatgataacttttatcatctgaacaatagagttttttaggtataatagtgggagaaaaagatcagtattctgttgctggagagattctatttttgtttgatcttttcacatacactgactgcctgacacaccccaaataaatgtctcttttaaaagagaggaatgtccctaccaagttctacggaactccccaaaccacacataacctatcatggcaagtaatttttagtgttgcagtagaaatgggcaagaaaaaaagttttgctgtttaggtattttttagacttaactagtcatgggcacaaactcctaagtctagactgaatatgacttattaattctccagaaataatagaggtagaggcttgcctatgtctttgatcccagggatgtcttcttgaattgcctccccgggtatcttttaaaatcccacctacccttactgatgcagctcaactgctgccacttctgtgtggctcagcattcccatcccaggaacaaccttctccacgactacatgcaacattaggagtctccccacttcctcctcttttaatgcactttgtgtacaacactttactgtagttacttacagatgtaatcttctagagcatgacaggctccaggagagcagaaaggcgtatgtcttccacacatttatgtctgcagaaatagactgttttcttgtatttataaggttgctataaggtatttatttgaaaaaacacctatgagtgattttgaggctgagtattaacgtagtcttcacccatatctttagttacttaaaccaaaagtaatgttaatactaagtttaagatcctaagatagtggtgagtcttaaggtagggtaaaacccatcaagcatacttataatatccagggtactttactatattagtacattcaaaatcgtcactccatagtttatgtttagagagagcaagactatccagccagatacctcacgccatccagttattcagatcgacagtgtcttatcgtttattagtagctttgcgttttttaaagagaggatctggacaacttgagcatggcagcgttcaaagatttgcaaaactaagtgataccactgtcagactgaaaattaaacaatcagccaacaattagtccaagaaaggaaaagaagcatctgtaagaggagtagaacaggttttacttttgtgagttgtaactgcatttataaaaactacagcaaagtagcttgacagctgctcctgggctctcatagcacttaggacgttgcagtcgtaacctgctggcttgttagtcctcccttccaggtggtatccaagaaggtaagagcagtattttgctcacttttatagacccagggcacagtatggtagatagttaactatgtgctgaccaaccaaaaaatctttatttttatgagccagaattctagaaaggttaatttcaataaggtccatcctatatccacaggatgcctgtaatagtggtgtaaatattcaatctttgcaacttgaagggagatgggcctacttttggaaattttcagaggaggagtgtgactactactagaagtagaaaaatatgggctattaactgcaatgacagactataaatgctcttcatccaataataataaactgtcacgattttatcagtatttgtttggtcccactgtttgaggttccactataatagaggcataaaaaagctaaatgcccctctttttttcttctacccaataaaaggtatatggcctattgctccataagtaggttaataggcctaggtactacaatttcaacaaacttattaaaaaacacattttctttgttctaggtaacgctgtaagcaagcagttgtcagtttccactacaattcatttgtaaacctcttataaaaagtagaaatcttgcaatctgtttatcttaaaaaaacagaatggttaaattgctaacatttttttctcagattataataatgtaaaatgatgttaacattaagaatttcacgtaggccgctctaaaactgaatttcaatattgttcagataatttccaagcacaggttaaaaaaaaaaaaaaaaaaaagggagaaagacgaaatttctcctcaaatataccagtagttactataccaacttcctttgctgagaatttttccactatctgctcaattataaaagaactgctgacatgcaaaccaatcaaaataccgataaaacatgcaagaggagagaggtgaggggaggatgttccaacatcacaaaattagagtattaaattcatataataagaagagggagtatggagatttaagactaattgcatgttgaaaaaaggaagtgtcttgtcactcaactacgctcttgactagtaggttgtgaattcaagacaattacttttagaatggcttttaccaaaaaagccgacagatacaataaaattaaaataagtcatttagtatactttgtttaaaaaaaaagtgtttcattattatactcatttgtctgaagttctatagaagtagaatcctttcacaaaagatcagcaggaaatccttttaaccttcacagatctgttaagggtgtatacaagaactgaacttctatgcgaaatacggggttggcagagttcatggtttgtaacgtgtgtgacacacaacaacactaacttaacagaaactgaatttctgattttagggaacaatctcttgacaatctagcatttgtgcaaaaaagtaactttcacacagcaacacttaatcccatgagggaattaaagattgccagtggaagccgagtaagctactttcctcctgtttggtttttaactgacgtgtaagggtgattatctgtgcaaaaagctgaaggttgaatcccagccataaaatggtgtcgatatccgatttcccaaactttacaactagcagatgagagtatgttctcctgtgagaattactcatttagcagtatttgaaaactaatcagaaggtgtcattcagtccaaaaattttctgcacgttctacttcaattaacttgccttttggaattctaagaggtaacactgctttccactaaaactctcagggaacttcttttaattcaagaaagcaagtctgcttattagactgagcacaggtgcccccgaattgtgtataaagacctactcaccacactgttctttcccttcaactttgtttattgatgtactgaacatgaaaaagtacaaagaatccaaacacaaaagaaaacatgtacagcctcttaaatactcaacagaatatattttctattccaacagatgtgaattaagtcatactgtacaacttcaaataaataccagccttacattttattaagtgctctgataaaacactgtaaagtgaagcacaatttgcatgccctctcatcaatgccttggtttgctacagtagtataggaaagaagcatgtagctgctgttttcccttgagggaaaccttattatttttttttaagtatatacatgtattttattttttagtgtttttctttttttaaacgcagaaggttaactctggcaatctaaatgcacctaaggatatgagaaagtgctaagccaattgatttctgaatagcattgagtgggtcagcatgaaaactcgcttattcactttagcacgcgcctcacagtatatgtactgtactatactgaaaaattttataactacaattttaaataataaaaaataaaactcaaagcaaccgcaaagataatgtacaactatgttatgcatagcacattgcctgttctaaggggaagcatgtgagcatctcagtttatacaaaaagcaggacgtaactatatagttctcagtgcatcctgatgaaggcatttttgccttcagcttttttgaaaatttattataagctagatgctaatcagaaaatattttgtattttttaaaatttctttcatacatggtaaagacttattttattatttccccaaatagtggtttttaagcatcatacaaagttaaatttcaatagcatacagatatttatgatttttgtatgaaaaatgtaaggaaatttgttcaaaacctatggttatactcatttttttataccacaaacatatttataaaccaaaatgtagcatcaccataaacagctgaagctagactatctacagacaaaatttgcaacaaatctgatgcactgtaaattcaagtcctcaggacaacaaaagtgattaagcaagacctcaagtaacaatgttaatgccatttacaaaggaaaaaactgatacaaaaacattcaaaacctgaacatcacttggcatgtaagggaaaaaaaattaaattagctgaaaggttcataaacacaaggtcttatttacattacacaaagctcaggtgttagccttgaacgtaactttcaaaataccttcaaatatatccaactcagatcacttttgctgatttgctgcagtacaaatcatgtgcaacgtcttttttccttaagacaaaacaattcttcaaacaatactgcaagtacatcactaaacaccatgagctctatctgaagggatttctttaggaagaacagattttttcccccatctctcggtaatttaaatttcttgcctgctcttatatattcttttgtaaattttttttatttgtttcaaaatcacaaatcaatgtgagccacctatcacataataaccaggatgatcagacgctccactggtgattacaaaaatgaaaccagcagtgtttccccccattgattctactcctttcatacaaagatctcaaaagtattttctacaccataaatctttctaaattttccaaccgctgcaaatttcctggtaaattttaaaagctcactaggtgtcatatgaagagatttctcaaagtattcaagtcaaaatatttgttccaggaccagtaaaaagtttctccaaattttcttttttataaaaatagatgctttttttaaacccacatcaaagaggctcttatctctttggcaaggtactgctttacgaaaagttctccagtattcttacaataagcgtttataatgtagcccccccttccccaacccaaatcataattacaaaataaatactgttttaaacttcataaataaaaatgtaaacttcaaaatacttttcttaaacagacataacagcaatgctttaaatgtaaaccaaacacaaagctaatcagaaaaaggaaaaaaaggggggaaaaaaaagacacaaccaactgaagaattacaacacaaagcctcaatatttactcacaggttcaaggcagttatgtaaaaagaaaagaaatgtcttcccttagctgaaacactttaaaaggtccaccttcttcaaagaaggcaatagaatgcaatgtgacaggtaaaaaccctgtacctcttgtccatattcaaacataaaagatatttaagaagttttaattcaaatactagcaataaaaaatctcacatatttcttaggatgctaagtagtcattttatccccatctcaacactgacttacaaagacatttactaatgtataaagtttctcttaacttgcctttgttgtatagttttcatatataaatggactgaggacaagagctcattaggctttgtgcgttttgtttgtcttaaaggagacctgcagtactctgtctcccagacggtatccattgaggctagctatcgccatggcagcctcatcatagtttgtcatagtcacaaatccaaaacctttgcatttattggtgttaaagtcacggatgaccttcacattggtgacagctccaaaaggcccaaacatttgccacaggatactctcatctgcgtcaggagccaggttgtacacaaatatacaccaccctgttccagggtgcccagggatattaattccagccaaactggtcattccgtcaatggtcattggagaaaacctgctaaacagaataggaaatacacacatacacacaaaaaataaaaacagaggttggttatagcaatgaacgtataccttttccatccccaagaattttagtaactctcctcccccaacaaatatataaactatttcatgttttgaccaaggtctgtgtgtggctttgcagtgacatgctagactactgagatattaataagttatgaaatgaccattattcactgtactgaatatcatccacaatagcaaagaaatatatttagaactggcttcatgaattaagcaggattggcaggggaagggatcaacacatacgtaaacatgctgtaacgtcgtaacgcaatacgaaacaaatgatgggtttttaaaagaccaggtggcatccggtggtataaaaatttcttgagtcaattgtgcttcaaagagcagcttttcattaggttgcacatgcaaaataaaacccaacaaaaacttatgaggggtgtgaatagcactcccaaaatcaaagaaaccaatcaactgtggaaagggattatgagtatcatgaacctctatcattacctctttactccataagccatattgagcagattgtccaacctgcaaaacacacatttagcaaacttcagtttttaatttttccccttgatgttcaagaaagttgggctcattactgccatcttccgaggggatatctgtacactgattatatgtgaagactcagaatgctgggtctttttacgtttttaagctaatgggcaccgactgccacaggacagttcttccaatgaatggtttctctctacaagggtcagtacatgggacacagtgacggtcatctgaggatacctttcagagaggaagtgcgaaagctctgggatagttaactttagggttctcatcaggtagcttcaaagtgatcaatgtatagctacatgttctttatactacttttgattttcacaactctgttggtgcctgcagatacctaaggcacacagggtttaagtggcttgctcaagaccacagggctagtaaattatggcattgatactcaaactctgcaggttacagaattctatacattttcctttcatttcccaactttgaagggctttcatcttttagaatcaaggaggtataattacaggtagaaaaaaccttatggacaacccaagctaaccctcccatttctcaaatgtgctcagctgaggtctagagaaggaaaaaagaaaaatccatcactccagtgtgcaacaaagccaagagttcagatcctgatctggatgctgtattcaaattacgctacaggaagtgtcgtcctactcagttttcaaaggccaggtaggaaacaaaacaagccaatctgagcctcacttaaaatgtttatagaaagtaaataggggtgggggtggaggtgtaagtactctttaaaaccttctacatttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaactgctacaatgctcaacactctccaaagacatcccagggttgtccctctgggactgggggtgggggtgagaattttttctttaacacccgtgaaaggtaagtttgaaaagtctcagccttatcacctaacctgtggcatcaagtcacgctaaagtatacatgcaaaagccaacaccttttagttttgtaaaagccaaaacacatctcatctggtctttcagaatggggaaatatatagcctcccacatccctgccctcagtctccactgaaaattctgttttgtaaagatgagaagaactgagcttatgcaaagtgtaaggaaacagaacagatcacaatgacaaaagatcttcgtgtgtgagtgtgtctctgtgtgcgtggtgcgtgtgtgtgtgtgcgtgccttgacccaccaccctctcattgcaccactgagcacaagccagggtcactgatagtttataataaatatgtgatgaccaaataaagacaatgaggttaccaaaattatggtcaacttagtccagaatgaaaactagtaagaggattggttggatgaccttgtctgcacataagtaaaaagatgtggggttttattttttgcagaggtgagtacagtcaaagatgccatgcctttatagtcaagaataaggatcacaactaccagcaataaagacaaacacatattagcaccaccaatcataaagtaacaatacaattttatcaaattgctggaatgatcaacacagaatgcatttggcatatgctacctgtagaagagaaccgcatactgaggtctccaaccaaagtgctagaagacccagaatgcagaggcaccttatcaattcactcaaaagttacatcatctatgcccattaattgcatccatgtagggacaggtcatgctttgctaccacccactcaggacaccaagcatacggcccagagacagatgagttttcagaattttcaaacagggtagaaaccaaatctgcccctgaagtgaattaccgtcaggccttttttaacaatggggatatgttctgaaaatgtgtcactaggtgatctcgttgttgtacgatcatagaatgcacttatacaaacctagatggtaatagcctaccacacacctagttatatggtatgggctatggctcccagtctacaaacctgtataacatgtcactgtactgaatactgtaggtaattctaacacaatgctaagtattgtgtatttaaccatatctaaacatagaaaaggtaatgcattgcacaatattaggatgactatgatatcactagacaataggaattttttgcagtctactatattatggtaccacggtcgtacatgtgattaactgaaacgttatgtgatgcatgactgtacatgcagtgagggagaaacatttcgttttccatcctccatctccctcacttccatctctggcatccccagacaggaggtttcgaattttttataacaggatctccgaggaccctccaaattatgatagggcatcttttttaccctatctgtgaagttttacatgataccatgatcttcactgattccttcacttctctctcattttagaaaaaaattggtcctttggaactaagccaagttatccactctaatctttcttctcctccatcaccaacgagtgtagggagaagcatggaacctagaaaacagtgcccaggcactgctgaagccccctgactgtatgcatctgagcccagaagtatttcctagctttctcggtgccatagattcatgtttcccatgggagctcagaaaaggcaacgggtgctctacatgggcaccattcactccaaatccagtagcagttggcaaactgtaacacaggcagttgtaagagaaaatagtgcagcagctcaaacacaaggactactacaacaagcccctagaaatatgtctgctgggtctgtccactgctcaaggacatctttttattttatttatttatttttgagacgaagtctcgctctgtcacccaggctggagtgcagtggcgtgatctcggctcactgcaaactctgcctcccgggttcacaccattctctggccccagcctctcgagtagctgggactacaggcacccaaccaccacgtccggctaattttttttgtatttttagtagagacggggtttcaccatttagccatgatggtctcgatctcctgacctcgtgatccacccgccttggcctcccaaagtgctgggattacaggagtgagccaccacgcccagccatcttttatttatggtcatttataaatggaagtcaatttttaaatggagagcaagctagctgcctccagaatatctcagggaggggtgtggatgataacgtagtacatatggaaggtaaatattaaagtatccattaaatatatatttaaaataaaatataaaataaatatgtatttaaaataaagtattttttacttatatttaatagatgcactgaacccagtaccttctcagtcctgtgtatcacctgcctccctgggggaagactgagcaatcatcgaaggggagaggcggcgagtggcactctctcctgctctttagcctgaacaaaatccattttacaaataacacagcaagcagatatggaggattagactggataacctgctttaattaaaatgacctccatttaaagaaaaagtaacttaaaaaaagattactacaaatgtaaatcagagtaaagaatggtaccagtaagggaaatacaagtaaataaggaaagggagagccgattatttctcctactcttagtacaagctacattataaggttagacacaagataatccaacatgcatcacatgaagtcagatgagatatctgaaattattttatggtcttgctttaaaagacatttattaagatattaggtacatggaaaatgaagccaaccagtatagtaattagcaagacatttaatacagattgtctcatctttatccttttttatgtttgattagagtttataatttaatgaatagcacacgcccatgtacatatgtaatttatgaaaaaggcacataggagagagatgtgtataaacatttttctatcaacaggaccaaagctccaattataacctgtcaaaattttgaacagaaccatgtatcagatcattcctattttaaagctaggtgttcataagtagaaaataaaaataaagtacctgcctaatttctaaaaaaattagctgatggactatgggaaggcctacatgtaagtaaggggaaatgtgaacccgattaaagtcagaaataaaaataggaagataagttattgatgggtaagaaaatatactcggaatcccacaaataatgattatcaaaatctctccaaagcgccaaccgagaactgcttggaaattatctacaacaagatcatcttcttactgccttactgccttattcaattagatggtatcatctgtcctctaagaaagaggaaaagtattcaaggggattgataccggtttcttccaaaaggaaattgtgataatgcaaccagtacgtcatgccttaaaggcaactcaagtgctcatttaaaaggctttttaaaaaatgcataaaggctcatagaagcaggcacacaggtcattacactagatcatattcaataaaattatagctgtttcacagaaaagaacatgaaaaaatttggcttaaagtttaattctgatatcatgtcccaagaatatacttaaggggcttgaattacaccatccatccaaataaataaggcttgtcctattttgaaaactgcagtcaattaaataagcgtattagaccagcagtgctcatattacaacaattctctgattattcatagattgactaagccataaacctcacaaacccacctttaaacttaacccttattacatggatttttaagctttttgaccataaaagatatggctcatactttatgattattaaaagtattcttgaccataatacatataacttatattgctcaatctctctcaactcccaaggtactatgagaacataaaaatacagtgagaaattttctacatgtctgctgaaaggtgacaaaaactcaaggcaagagcattaaaacacaaatatcagggacaaaatatatctgtgtgatgatttagactcgaactacagaaaacagcaaaataccaacaaaacaagcaagcccttaattcaagtttctttatcaggtgaaagaagaagggggagtggggcggaaatcaagataatgacaaccaggttcaatatactgtattaaagaaaagcatcaaacatcaggttaaacctgaaatctgatttcttccaacacacccaatctagatcaaacactatctctgagcacactaactcgttcatattttattatctggacagggatcatgggaggaatgagaaatggggtgaatgggacaacagttaaaaatctgaagagagaataacaatttctcccattttctgaaaccaagtttcccttacaactgacaatctcttattctcttcttccaaaatgtctttctataggagtgaaggaaaaagaattttcaagttaatgataacatatggtactaaaagataaaaacacagaatgggccagaaaaagataattaaatttgaccataagaacatcctgtaaagctttactcaaccaaaaataaaaagcacagagcctgcagggatggaggctaggtaaacctaagggctgacacccatcaacaacctagcacctgagtcacctacaagccttgccatttcaataatcaggcactctcccaaatcctgtcttctcaatcttcctaagaattcaatcttgattccaagaactttgttttacttaataactatcaaacaaaatcattgcttcaatctggaaaaaaaaagtagctaatatagctttccactaacagcaaacattttataacttcacaatgttaaaaatcaaccaatacattatgaagaactttgttctatctaaactcgagatcattttcaaggccccaaagagctctgaaattaactggacaagctgcctaggaaatacctgtaaaattccttcaggcttgttcatcctacgtttgcaatttaaaaaagtatatttatacatatattattcacttaagatgtcacagaggaaacctatgtgcagagctgaaaaagggctttctttgtgagacttctttctccacaaaggcaagcatcaggcagccccacgcatctcccacactagtctgatcaccactaccatgggaagtcaaaggtggcaaaggttttttttttttttttttttttttttttttttttttttttaataccaatgccttttcctcacagcagagcatgaagtacaaggctcaatgcttttgacagtaccacctcttctcccacggcaaaggccaacttaagttgaaatttaatgtggcattcataacaaatttccttctcatatctcaagcaacataatttagtatttttttaaaaggagctatttttaactgattttatctccactctcttcagcactgcaaatattccaatgaaaaaaataaatgcatagatttaagctagaaaacataactcctgatcttattaggttatatttgtgattatatttttggtaattaactattctgtcccatgaatgaaataaataaaattgatatgcacttggaaataatttttaaaaatcagtgtggggttagatagcattctgggtatagtgtaccatatggccaaaaaggatatttaaaaatgtcctggaaaataaaaactgcatgacttgcttatgaaaccaaaaactctctgctctgcttaacttcttaaagtcactgttcttctcacatgcagattagagattttttgaatgactcctggtttgttatcccaggatcagaataaaacttaaacagttagcatatgtacacctgtcagtgagatagagtgtcttctttgggctaaagccacggtcattctatgaactacagagaggtcagtaaattacaaccgacaggccaaatggagactgcctcccacctgttgctgtatgggctataagctaagaatggcttttacatttttaacaggttgtttaaaaacaaaaacaagacagatgcaacagtgaccataacccataaagttaaatatttactatctggtactgtacagagaaagtctgccaacctgtttgtaaacaattttgaaaaggaagagaggaactcatttgtagaaacttcacgtagtcacataggttatatacccttaatggtgcacatactataaagtgaagtaacagaaacagcttgacctaaaaattgacacatgagaataaaatcctttaagaaaaaaaaaaaaggaaatctgaagccctggaaacaattcagataaccccagaaagctacagattagaatttctcaaccacagcattattggtgctttggaccaggtaacttctggttgctggggctatgctgtacactgtaggagcttagcagcatccccgacctctagcattacatgctagtagcacccccacaggttgtgccaacatgaatacctctagacattgccaaatgttccctgggaggcaaaaatcacccttggttaagaatcactgctgtaggttactgtcctttggtccccaccttcaatattagcaaaagacactattcctcaagtagattctctctgtgcccatggagatgaaaaattaatagtaataaaaccaacaacactgacaaaagcaaaccagagatcctgtcaataaaagtactggacagtaaacctgagtattctctttcagtttagtagctgggcacaagaaccaaaccagacttacctaaaacgctgtgcctgctgagctagcggtcctggataccttctgtttggagactggtacagctgggaaaggatggcctgattggttttttggcttgggttattagcaaactttacagtgattggctccgtggcaccgggaggtttctggccatttaggcctttgatagcttcttctgcctcaattcgcttgtcaaatcgaataaaccctacaccccttgatatgcctatggtagatttgagtaaagatttggaaaagagggaacagaaggagaagggaaggagagaagaaaggacacattaatttttccttctcaagaacatgttttcacctacatataacatttcccacaaaatcacaccaggaggaaactttcccctttacttactagccattcagtttagaatcacaattttgcatttttagaaaaattcgtgtcacttacataatctgagtacccattatcacatgcattccaatcagctaagacaagaaaacacaagcatgtccatgttttctctctctcccacctccctcccgtacactcttttaatgtcaatagtgtaccggagttccatttttcaatttgtgctattggataagcagctcagaaatgagggacacagtagttcctgtccttgaaacaaggagaacagaaagaagaatttgctaaaaatgctacaaagctatgctaaaaatacatacactgtggtagaaagacatttcggttgaaattttaaataatatattcagcttaataatattgcataggatataggtcctttaggaaaaaaatgcctgaaaatgctcttccagttctctgaagctctcttgtgcttctgactagctatattttattacagaaaaatattatatggagaaaaagaaaagacgtagattttaaaaataaataaatttctagaagtaaagcatcaaagctttctgacctcagcagcatcactcctgactacagaagatcactccctgccccacattctccccagtgtgaaagacacaaatgggaaaggatagccaagaacctttccaggttatgaaaaattgtagagggaaacccagcttattccatttaattagcgtgaacaggctagtggggtgaccacagctggtcatcatgagataagcagtggcagggaaattttttttggcaagtaaatgagcactggaccatcatacttggaggagcttaaaaaaaaaaaaagaaagaaggtctacttgctttaaaattaatactgtgtaaggtcaatgactaagaattttctaatgtagacaaagcattttttccacatatgcgtatctaagacagcccctatcactttaccttttctatttaaagagcatgcattgcacattattaccacctgatggctgaataagaaaattgcagggtttcatttttcatttcaggtaaattgagtaagttcactttgaaagccttaagtatgaagaataaatagtgaaatgatagcaaatcctttcacttatctactagcgcctattaagaattaataacctctagaatttagctgttccattagaaaagcatcagattagcaaaaaaaaaaaaaaaaaaaaaaaaaaaaaacagcctctacacagctagagtcacctaaatcggtggtcctcctacttaagcatacctaagaacaacctgtggctcaccctcagagatttattcagtaggttctgaatgaagcccaataatttgcatttttagcagggttccagaagactgctgatactgcaggtgcgggacatacttgagaaccgctgactaaaacaagctaggtccacctgtgatggactagcaggtaaaagatgagacgcactttgtgtcataggtgaaacctactctcaattcacaagatctcagaatgaatgaattagaaagcacaaatgaaataaaaaatatttttgttgctttgaacaaattcatctttatttctaggcctggatttctatttaacaccattattagtctatgtgataacaacacagggtggcaatgtataagtattatgaattaactaacacaattaaggaggctgtattttatatactctcacttgactaaatagtctcatgacagcaaaatctgtaggctattctcccaggcatgcatgtagtgctagctctctctactcagaactctaaaggtggtgcttcctatgaagccaattaacaacacagaggcaggtaatatgggctcctctgattagattcagatcaactaaatggatcttcacttgatgaatgaaaaatctggctcaattttcttctgaagtcactgctttaaaagaattagacattgtaatatacaacatgcctccaaggtattattattatacgggtggcggggagagaaacaaacagtgaggagaaaagctaccttaaaaaaacaaacaaaaacaacctcacaaatcttcatgtggctgcttcagtctatggtactacagctaatatttcctcctcacaatgtttctctattttttaactgtttcctaaagaacaagtattgctttcattttattttttacttattttttgaaatggagttttgctcttgttgcccattgcccaggctggagtgcaatggcatgatctcagctcaccgtgacctccgcctctggggttcaagtgattctcctgcctcagcctcctgagtacctgggattacaggcatgcgccatcacacccagctaattttgtatttttagtagagatggggcttctctatgttggtcacgctggtcttgaactcccagcctcaggtgatccgccctccttggcctcccaaagtgcttggattataggcatgagccactgtgcctggccaagtattgcttttataatagaaaattgtatctgtattttatttttaaaattcataatcaaatctatattgctatagctttgttaactaagatttggcagaacaactcccttacattcaagagttttaatgaacattttagtcttcccatttcagttgggctaacagtgatattaggaataaaataaatttttaacattcaaaatttcaaactcttacatatgcccatacagcacagcatgaacctggaaaacagcctgaacagcaattaccagtgtggatgtagtgtaatcctcccttggagaactagctgcataccgctgcattaaacttcgctttttgacaaaagaaaggttgtttattagtactctataagcaggatgggggcttttatcacacagtggcttggaaatgaagattatagcatctataaatttattacaagccatgaaacaggcttcaatcctgcaccttcagggtggaaatgactcaagcacgctcactatactccacaatctatttttatccatgcatatttatgaacaattccagcagaaaattgcattttctggcccacatatacctttgatatgttctagaagcaagactgctacatggaaagacagaatatttcacaatctgctagtcagagacagggaaagactgtccggagtggctgtctacttaccagtgacctggtcgacaagaatacgagaagtaataatgcgtccatattgtgaaaaaagctgttccaactccttctgggtcattgtttttggaagtccgctgacatataaatttgcatctctgatagaagctgaacttgggcgagcataggaaacctggaaaaggaaaataaaattaaatgtatatgcatgctcactcacccacctccctttagaaactcaaaaactgcctcggtaactttcccatgaacagcatagaacactgaagttcaagcaagtcaggtgctaactgctttattcatttccaggaaaattctagacaaatgggtagtagtattcccattccctctcccctaggtggacagggaagagtatctgtaatatgctggactagcctactgcaagggacagaaatttcacaatatatcccatcctccagattattactaaaaatggtcaatgggtctgggatcaatttgcggaggtatagtgattcaacaactgcctgctcattttatcatttgtacccacctttagtccagttttaattcactaaaatttaaagttcttaaaacagaccagtggtgcatacagcacagtactgttcacaataataggctgtcttctgtggggccaatcccctagagcagtggtccccaacctttttggtaccagggactggttttgtggaagacaatttttccatggaccatggtgggggatgcattagattctcataaaaactgcacaatctagattccttgcatgtgcagttcaaaatagggtttgtgccctgatgagaatctaatgctgcagctaatcggacaggaggtggagcttgggcaataatgctggctcacctgctgctcacctctggctgtgtgcactggttcctaacaggccacggactggtatgggtccatggccaggggttgggaacacctgctctagaatagggatttaggcccaatcattctaagcttaaagattccaaattcatggaacatttttgttttctagcctctcacatctgtgtgggtggtagtgctacatttctaaaaaaaaattcacccttatcagtaagtatgctcttttgatatatgctgtatgattgtccataaattcccagaaatttgaatgtgtgaacaagccctcattatcctttgtctgttgtcttctcatccacaggtctttttaaccttgattttcaaaaggtcttaagtccctataattaactttgcctgccactgtatgtactttcaaaaagtttcatgtctttgagatacggtataccaaatcccacaaggacgaaagacaaaataggtctgcatgtatttgtttataatcatcattcctcatgtaaactctgtgagggaagaaaccacatcattcttggtcatcactgtatcctcaatgcctagtgagtgcctgacatgtgatagatgctaacacatttggtgagtaaagcccatccaataataccccattgatcatgcagatccacaacggcttactgaaccagagcatttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtcaatgtgtctgggattgatttgctgaggtaaagtgataactactgcctgctcattttattattggtacccacctttaatccagttaacaacaaactttcccaatttacactaatacttaaataacttttagtatgaagcaccaaacattttccccataatttgaattgtgcccacagctctctgttgccactttttcttggctttccagaaaaaaatataagccacattttatactactttataaagacctcgttatctttcacacccctgccccaatggtgttaacatttaatactcttctttattcaaaccgtttgctcattaacaagtgaaaatatacctgttgttccaaaggctatgtttggaagttatattagcactgtcctgttctacagaagaaacaaggaatttggaatagtggtggagaaaacatacataactattcatacgctatttgttttctctatgcctaaatacttaagaacaatgaagactggggaacttaaatgtaagtgaagaacaagtggccaatttcaagtgattaatgtaacttagatggaatcaaatcttgggattgctataaactgatgaaacaaggccaatgaattatatatgcattcagtaatatgaatcaatgaaaacttaatttcttttctcgtgtaagattctcaattatccagaaaaggtgaaacctcaccagctgggacgtgcatccctatctaggattctatggcttttttttccacaggagggagcacccaacaagtcagctgttactctgttccagatcatgtgactgaagtactcccattatgaacagccatgtcccatgggctccagggcaggcatctacacattctccaaggaggctaacttccaatgactgatcaagcaaccagcagcaggtgacaggctctgcatgagatcaagtgtcacaggaggcagtggaaatgtggttaaaggtaacagctaatcggtgtgcctgggctcaaaactaggtttaattcataaccagttctgtgaacttagaactaagttcttcaagcctattaccacaattctaccttctttatatggctattaggaataattaaataatttctaatccacatgaaaagcttcagagcctaatctatgtgacattataaatattatttacctctacatgcatctgaaaatttaggtaaatgcccagccccttaaagtagagagaaacctgggtccattacagtgttctagaacaatttactcatgcagtgacattcactgctttgtgcaattcagatgagtgtaggtggtgtgtcttaaaagtcatcctaaaatatatttaggaaaatgggtttatatttaatgcttatataaaggctttgaaaacatacctaggtcagttatgtgattttttttttccccaatgtccactcttcagtttatattgtatctttagttcccagccacattaaaaaggctccaagacaaaccttctcaaaaacagtatctttcagtgacattgtcaaagaaccattttccactaccacaggcaggacaggagtgattagattatatataaacttacgtcggtaacaatgtttaatgttaaacttacatttagggcattatgagacttcaccatttacaaggcattttcacaaactacaatattttgtctgtgcctcacaacaaccccatgaggtaggcagcatacatattagtattttatagctggggaaacaggcacagacaaggtaaataacatgcctaaggttatacacaactagtgttgaattctgggttcaaactctgatctttctctttctgtgtcctggtctcctcatccagttttccttcaataatactatggtaagtgagtgtttcagttcacttgttctgagttgggaaaaattaaatgaatcctggctgtttcttaaaggcatacacagagaaactggccacagacagaaaacaggatgttgctagaaattagttaaaagttattccactttttattattttgagacggagtctcactctgttgctcaggctggagtgcagtgggtgatctcggctcactgtaacctctgcctcccgggttcaagctattctcctgcctcagccttccaagtagctgggattacaggcatgtaccaccacactggctttttttgtattttttagagacagggtttcaccatgttggtcagcctggtctcgaatgcctgacctcaggtgatcagcccacctcggcctcccaaagtgctgggattacaggcatgagccaccacgcccggctccattaatatttttaagagtaattttttctaagaaaagagaagtggccactaattacaattaaccaaagaaactacacatcatcattagaatttttaaattaatttttgttactttctaattctcaggagtaagcaatgccattttcgttcactttcaggaaataaaggtgtaagaaagggtaattgccttctccttcctcccagaccaaggctcaaggtcctacccctatccctttatttactgttcttggaattaaaacagcttcctttcccttccactatcaaggatatcgctgtcatcaaaatcctcccttcctggaaaacatttcttctttcatctaaaaagattataaatagaaaatgtatttagacctaagtgggaagaaggctgatagtgggataaggactcacactctggagatcagttacctaaggactcacactctggagatcaaatcagttaccaaactaaattttgtatctgaccattaccagcaaccttctccattccgattttttttttttcctgtggatttagatcttacaggtgccttcatatgcacctacagaatcatacaggggctattttcagaaagtgttaagtatctttttggttctacaagactaaactcccttgaaggcccaaaagagttcgctttaaatgacaaattctatttagaaatgcttcaaaacaatggacttccagcatatgtcctactgaggtcaaaatagcctctttctccactgcaatctgttctccattttccatttgctggattaatatatgagtttggattttaaattttcactgccacttaaacaggtgaatatttaatgcatgagaagcaaggttatgaaatgtcaaaactactaagtgaaggatctaatttaagaggcagccagagagtctgcaatttaaatatttaaagatgatacagggagtacaacactgaacaccaatctactccaaagatagcaatttaaaactcaggtttattctggaatttctcacaaaagctacgagtgatataataaacaaagacaagcaatactgagattatatgagggaaggggagggacggggaggcagtaagtacttgctactacaggtaagtaaatggcccatggcttctcaaactgttcttcacaaacaagactagactagacaaaataaagatagaatatatttattgaattatgtcttgaaaatggaaccgtttgaaatatagtgtattacttgtaattaaaagctcatttcttcatcagcagctaaaactaatgatacattaaacatacaaagatgagtaacacatacactaagagtgggctatcaaacacaagttgatcaaaattatacaaagaaacaaaaccatcttatgaattagtactttattaaatgtacatagcaatgtttaaaatcccagtgcatcactatcagaagtccctctaaatgctttcgtccaaacacacaactgctctcgtttctctgattcatcaatggaaagatcagtgacagtggacattaataccaatagattaaagtgataaggtctataaatgaacaaagaagttccctcttttttaaactaaaaacatttgagaagtcacccactgctaagatcaccactgaacaacttttatcacttgtcaattactgacccaggactacaaacattaaacctgaaaattagacacttgccactttagacttttttcaaaaagctcctttcaatctctccagctgaaaggtcacagttatgcctatttaaacggacagttaattgctgttcatattttttaaagatggagtcttcgtgggactatctgaaaaatgacactataactcaataaaagttagctctaggctctaagtaagcagtagcaaaggtcttgtgacagcatcatggatatttggacaggtggctacatcggaccttccaaaatgagctcagaagtatagtacacagaagaagggggatctctaaccacaactcaggccagagacctcaaaattcacccaaaaggaagatgtgtactttgatctgcttctaaattcaaactcctaccaggaacaagtctcaaacacacatcaaggcatacatgtatcacagtccaatattaagttttcaataaggaagggcatatttcacaatgggttgaaaatgaataagcctaagataacaataagaaattaagtattagctccagcaaagttagagctaaaagaaataatcacatccaaacaggaaattttataaaaggtattaaaggttagggcagttatctttaacggatattccaaaatataggatttagaaaactatcagtggaaaatacacacagaaccttaaattttatcgtgactggatttgttgaatgttttaagactaaacaattgctttaattcaagtgagaagttcagagataccacggaatatatttgataatgtcatcctcaacttaaattacctaaagggctccctaagactttcagataaattttagaattcttattcctttatggtcagagcactggctacctcttccatacaagtatacaaaaccttcggtagtattccaagcttcctgctctcacttctctgtgttaaaaataagctgccctccttccaatcagctaaatttcagtcatttcagacacctcatgggtatcacctagtccctaaagtcaacactaatcagtcctctccactacagtctgagttgggtgcctcttacctgcacccacactgcattatatgccttgttttcttaaatactgacttaaccaaaatgtacttatctcttaaccctttcttgtgactgacttaaccccttgaaataagaaaccttgtcatcatcctactttgtacatcctggtaactaccacacactcactgtaatgaagatgatttataatcacatattaaattgagagtttatttctgaaatactgtttaaaagctaacagaagccacaatctttgtcatatacccaacattatacgcattggtactttgtgtacagactacaatgaaaattctattaatcatttcaaaaatgaaatttcatttctcaaattggggattcaagtccccagaggcgacacaatcttcaacaaagtaatatggtgctgataggaggctgtggggcggggggagtcttaattttggagcaaaaagaaaatacagtgatcatttagtccaatttctttgtatctgggaaataggaagactgaggcacagaaaggtgaagcaacttttccaaagacacaaagaaaaagagttgggtgtaggactcgcggtcttagctcttcatcacgggattttccattacatcattagctgcaacacagtcttcaaaatcataaaatcttcctgtgaaatgacagtgactgggacaataatcagacatttccaaggagacatcagaagagctattcctagaaaataagaaccttagctttgctacatagaatattttcttgtatacacataaggaaataataaaacacatcaaaaaaactgtcttaggacagttattataattcttctactagtaatgcctgagaattatttaggagatgttggagaaaaaaatctaattatttgggagttgaagagaaaaatcaaactaagaatcctgagactagtactttccaccaattaaaacgtaccaacctacaatagctagaatctttttgatagtgtctctcccttttataagattacaaaccaattaacaggaaaacagaatggcaactggctgtttacactaggggagattctcattttcatagaattttcaagttttagtgcaacatcattaaatattagtcaaggcagttgatcttagcttcaacttaaaggcgacctaggaataaataagtaatgtcataaaaataagtgatcctatgacattgttaaagacaataataaatctactgaatagccacagaaaaataaaaagtgttttggctgtaagaactgtatatcaagcaactgatcatcaactacagacttcacaaattagaccacctttttcacacatcttaaacagcctctgacaaactacactgcactgagtgtggtttattaaatgctacccaaacagttgcatccatgtgtatcaaagagggtctaaataggctgccctgacaggcatctcgtttttagtaaagtacaactggtacataacttctgcccttttattgttgtttctccttggttctagtatgaagttggttcaacaaggacatctcatactggtaaaggcaaatgggatacatggtaaagatattcttgaaatgcaacttaggccataaataccttaccatttcttaaattttttacctgcagagatacttaacagaaaataaaacaattgagcaatggtagtggatatggcatctgaggtggaggcagtgaaatcaaattcactatggtagtggcagtaggctagccattccaagtctaagcaggaacttgtcaatcaaaatgttccatgttccatttccaatcctgtatatttcacttagccttttcagactttagaaggtgattacactaaagtagtataaaaaatagatgggagttttagcgtaaccaccaaagagtctattcctaccggtagctctctgcattagaaaattgtcagtagtggttaagaatgctaactcccttacttttaacttcagaaatgagcctgcatttatttagccacataatatttataaatactaagtaatgtgaataggctgcaactgaggcaagcacgtgttagcttagcaccaggttcaaaaatatattatacaaagcagaagagaatacactgtaactggtaaagttctggccactacacagcatactatgaaactagaggttaggatggaatgtttggaccagaaccctcccatgttaaggagtaaaaacatatggtatggagtcacacagagctaggtccaggtcttggctctgttacttaccagttaatcatttccttaggtcttctatctctttatttgtaatttgatgttaatcacagtacttacctcatggaaaccttacaagtattaaatgcaacaataaaactattagcaaagagcagaggaaccataaatgttttaatcataacatcattttatatacatacataggaaacaattcagataatgatagctcctaacacttattgtttaccatgtgccagacactgttctggatatgtaacatatgttaattcaattgctcctcccaataagtttatgcagcatcatcatccccaatttatggaacaaaaactcaaggaatactattatctttgaggtcaggaaagatgacacagaggaggagacgtggcacaagaacaatgtatgcactctaacacagaaacagttcaaaaatcacatatataaatgaggcttcttccaaatccatggtgataattattaaagttaattcctgaatattccaaatattttgtaagatgacagcagatgagtgtgctgggaagcctgcagcctggatggagggaacataaggaaggagctgtcttactgacatacagagagcaaacattcaacatctataaatgggccaacagttaaggccccaaaattttatttctcccatcaagctgttacatattaaacctctcactacctcaattctcttttgtagagacctgttgaacctaagccagtaaaacgtaaaatgagcgattcttttggatagacagtagtagaaatataaatgaacttcatggaataacttctatcttgagatgaaggttatgggtatgtttctgcatgtgaaatgtgttacaagctaccatgcaatcggccacctgatgattcaatatgatttcccagttaaaaaaaaaatactgaagaggctacactctcaagtaccactataaaactttcactttagacattttcattaaatatactatgaatacattcgagagactaaaagaaaaatctcagtactcactagtcagtactcagtattttgagccttcttaaatacggccagagaactagactgcctcaaagcttcctcccaagttaacagtattaccattcaaagcttttatattactatgttttatacttctagagggagggttgaaactaagtcttatatgatgcctatctcacatagtcccacccaccaagtagggactctactacctgttgaacgtatacattccatggccttgtgcaggaggtttttcttttttgaggcagagtctcactctggagtgcagtggcacgatctcagctcactgcaagctccacctcccgggttcacaccattctcctgcctcagcctcccgagtagctgggaacacaggcgcccgccaccacgcccggctaattttgttgtatttttgtagagacggggtttcacagtgttagccagaatggtcttgatctcctgacctcgtgagccgcccgtctcggcctcccaaagcgctgggattacaggcgtgagccaccacgcccagctaggaggttgttctgaagtacctctcaagcaagatgattagaagttgtggcatttgcccaaataacttggcttttgctgcttcactgaaaacaacgcaggctaaattggcttgcagaaaatcagatatattcattcaattgttagaagcccattctccagcaatggcttcagtattctttcaagattctgaaacttgacccaatgacatctcgaacagatgccaatactatcaagataaccatggcaactttatctccaaaaatgtacttaagatataatttgtgtagtatctgaatgtctagtatgcctaagacactgtcaacagattaaaatgctgagttagaatgttaaactaaagaaggactacacactggctggcataaataaactgcaggtgtcttagaataaaaaacaaccagtaccggttggtaatgtgaaaaaagaaaaaaggttctcatcaagccaattttggtgaattaaacatcctaggactttcatacacttcttcatccatgatctgacagagagaagtacatgaaaaggagaagtggataagacaagagacgggtaggtggacattatgtagaaaatctcacataacgggatacctttacttaaatctttgtttttcaccacatgttctcactcataggtgggaagtgaacaatgagaacacttggacacagggtggggaacatcacacaccggggcctgttgtcgggttgggggaggggggagggatagcattaggagatatacctaatgtaaatgatgagttaatgggtgcagcacaccaacatggcacatgtatacatatataacaaacctgcacgttgtgcacatgtaccctagaacttaaagtataattttaaaaatatgtatatataaaaaaactttgtttttgtatgaaacaaaaaagctgttaagtcctttacatatccttcatccgaccacatcttcaatgtatagtgacacctaccaacaagttttgaaaaacacacccaaagttaaaaatggcattaaaacaaaaacaaaacaaaacgaaaaacctccaagaatctcaacttttaatttcacttaaactgtgacttttttcgtctttgagcacacagagcaggtcttcactgtctcttataagcaatagacagaagcttcctcatgcagaggttataaataaaaacattctgcaagctgctctccaaagacaaaaatcccgttgccctcagagagcagaccaccaaatagatgagaaaggaaatgtatagttaagaaatttttatccactttattaatttattttatggccaaataaaactttatcaatgacagggttagagggccatgtaggcagagaataatccaaggcaatggagaattaggcttccatactgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatggaaggagaatacagagacagtttcccatcataacgcaggtgaggagaacagtcaaaatcagtgtggtagtaaagttaaatgtaaatgccatctacagttaagtttccctttgtactataactagaagaaaaactgctttgcaacaatgttcagaaacccaagtcttctttgacctacttcatatagtaatgaaaatataatgatcctttcctctgtgtgtacactaaatactgcttagagaaacttcatcttgataccatttgtaaatacttaaatgagtcccatgggtctccacggatctttgcagagcaaggcaaatatgtttctacgagcaaattacttgatccacccaaaattcattcctattgtttctcttataaattaggtcctcactaaagggggataaatgtaaagtacagggctaggtttaatcaaattttcctgccaatcatttttgtagaaggttattacttgatagaataagtatactttatggtgttcagatgtaagcttctcctaaaaggtacacatcacgtgaaggcctctgtgcttttgaatgagacattcccttatgtgtaatacatttcttctttttccgcccaataaaacctagcttgtaaaacaccatcaactctgaaatcaacacagaggcctctagacagcaagtggcatatccattttcattgtattctgcacttactcatcatatatccaaataatggtcatataaactaagtgctgtctcccttactacacaatgacatcaaggacaaggctacctcttgtcttattttaatgctgttcaaacatttagcaaagctaactagcccacattaagcactcaaaatgtttataaaatatttaattacagatactccctgtccaacactgtatagccaagattacatggtctcagtaaaacaaaaaaacaacttgcaattaaatacttctcaaaaacttttacatttgcttatcctggccctttgttttgtgggcaaggtgagcaccatgcacatcttttaaagctactgacctttcctacaaacttggagacaggcctattagtcttgttatggttccatataatataataaagccctaaggggtgggaagtcttgaacataaagtaactacttctactaaatctttaacgtattttaaaaataggattcctcaaacacccagagaaaaattcctaacaaataatcttcctcttaaaggatgttttatgtcaacaatccccatttaaacacctgttttaaatttaaaacacaatctgcaagccctatctacattacaagtaaaccatacgctatccaagatttagtgttttgggccctgatttgacacaattatcagggatctaatgtatgtatacaggtatacatacacaaagaagttaggaagccagctcactttctttcaagggcagcctgtctttggtaatcctcaatcagtagaaactgtaccagttttttaaaaatttaaaaagcagtaacagcaaacactgcagattgcttatggcatttaacaggcagagatggaaatttgtgtaaggcacgtatgataaaggagaaagcaaggaaaaagaataacagaaatgttattaaaagccctccccacagagccaaaggaagttttacctacacatattttgtggggctgacataagttatgcaactatgaaaaatttattcaatacataaggggataacccctgaaacattagtgagtgttgttttatgactttaagtctaccaagatatttctctcacaacatgattagacattagagaataaccatagggaaagctttttttaaatgaactgatttgcaagactaatagtctcattcaaagacaatccttcattctccaagtatctattagacacctgagctgtatattccccctaacagctttaacaaaaaataattactgtattcccaaaaccctttgtgtgacagttgtgaagattttaaaagaaagagtttttaaggaaaacatggacaaccttcactgtacgcaataaagagaccatatcattgccatctatgcaacacctgcagaaatttaaagaggggcagcgaggaggggaactaccacctttatctttgttctaagacaaagtgttctcctgcttcagatctccagaagcaccttgagaatcccgtcctgagatatttaattacactgaatgatttggtaccaggccctttccctgggtcttgctgactgatagcatcaataacactcactggctgtaattaaaccgccaaatagtatcccctttgccacttggcagataaatgttctttaatactccaaagaacaaagtacaaaggtgagaggggtgtttttacccctcaccttcacagttcatctgactttgtgcaccaggatatacatatactgtagacaatgcatattttacaattcccctcagacattgcttaatgaagaacatgaagaaaaatccttggtttcttattaattcatttttgcaactctgagcagggggaaaacactgtaagccttttggcaagagtatgcactgctttcacatagctttggggcaacatttggtttacaggtcaaaagggtttctaaattaagtttgcatatagcaaaaaattttttcctttaaaaaattatagcataaaatgtgtggaagctcttataatagagcaaattcccatttattgaggccctggctagaaagctcaaatatcaagacactgggtagggaaggaagaggggtttggttggcaggctataaaaataagacaaatttttattaaattttaaaagccacttttttttttttttttttgagatgggagttttgctcttgttgctcaggttggagtataatggtgtgatctcagcttactgcaacttccgcctcccgggttcaagggattctcctgcctcagcctccccagtagctgggtttacaggcacctgctaccaaacccagctaattttttgtattttaagtagagacgtggtttcactacattgtccacgctgatctcaaactccggacctcaggtgatccacccgcctcagcctcccaaagtgctgggattacaggcgtgagccaccgcgcctggctcaaaagccactttcaaaacttaactcccaatctctataagacaccctttcaccttttttttttgagacagaatctccctctatccacccaggctagggtgcagtggtgtaatctcggctcacagcaacctccgcctcccaagttcaagtaattctccctgcctcagcctccggagtagctgggatcacaggcacccgccaccatgttcggctaatttttgtactttttagtagagatggggtttcgtcatgttggcggccaagctgatcctgaacttctgactgcccacctcagcctcccaaagtgctgggattacaggtatgaaccactgtgcctggccaagacacccattttaaatggataggccctaaagaaccatactgaaaattctccaaataccctcagaagcaaataaattatgctagcataattgtaatgttgaagtatttaatgacacacaaatgccctgaaaatgagcaaattgtgtgtgagaacgtgcattatttcttaggtaaatccagcactatattcattaaaaacacattagtgaatcccagccattcaacatatcttgatgtaaccgacaaatgaaaatcctattttttacaagtagacttgttttaaaataagcaccacagacctacccaagtgcaaatcattaagatccactgaacagtgtttctcaggtcaggccaccatctgcttaagaatcacctgtggtggctgttgaaatacaatttcctcagtctctctctgcagataatcagattcagtaagtcctggttggggtgtagaaatctgcatttttaatcaaccaccccaccccactgatcctgataaacattaaagtgttggcagtctcttgtgtaaaggcatttgaaataatcctcaaaactctgggcatattagggtttcctagatagctcataacaaccacggatgccaagcccttttccttgccatccactgatcgttagtttctaaataagacaaatgccaggtagcttgaaagcaaagcatttaggaatataaatcacctgcaaatgcaaaaatgcagacgtaaaataaagcccatgaaactcatccaaagatatttccaagaacccagactggctggatgtggctcaactgggttagcctcttcaaaaaggccactgtgcttgattctatgaagttaggagcttctctcaatgactctttctaggaatatgaatatggttatttggttaaggcaagcacaaatttctagatagacatttaacaaccaaaactagaaactgaaactttttctgaattattagtttccaggactacatgcttgttctatttttccttgcccttcctgcagctcacctgatcaagaaaccaagaacagaacacaaatccaagacttacacctccaagtcctattgcagcattcaaaagagttcttcacagaaggaagggagaggaggcaggcaagtatcagatttcctgtactgttttcaaaatacagatgaccctggaacaatatgggtttgaactgtgtgggtgcacttaatatgggattttagaccaacccctccctcttcctctgcctactcaacataaacatgacaagggggaaggatccttatgatgatccacttccacttaatgaacagtaaatatattttgtctaccttatgattctcttaaccttttcttttctctagcttactttatattgtaataacacataatatgtaatacatgaaacatacaaaatatgtgataactgtttatgttatcagtaaggcttctagtcaacagtaggctactagtagttaggtttttgaggagtcaaaagttagactttttgctatatgggggctgctacccatagcccccgaattgttcaagtgtcaactgtacagctctgtctcattgcccaaaagcagcatgtcaagacacttctggaaataaaacatccacaagtaattctaatgtagtacatgcgggtgagaacacacactaaaagtaatgataggaatggctggcagaagtgaaaataaaagaaaatgcaccatccatgcttttttaaagagtctacgcaaatttaaagagagaccaatgttaacacacatttctgtaacctttaaactagcatctacgacttacatgaacctaccagaaaaacattgtcgaagaatgcgtagctgcctaaaaaataatttcaggaagttactactataataataattttactgttcattacaactgaaataactgaatcaatgttaactcacttatctgctaagtatgacctccagatccagttttcttctcaaactgtacgtctggctgtctcaagtgctcactctgcaagagggcagagttcttcactcctaggcaaagacagctccactctctggcacctaagagatctggtccagaaagtctcaagacaaagacactcaaaggcccaaattaaggcctctctcagttggtttatttagagtggtatctgagcaaaacagtttaacatcaataatgtgaaatggaaagaaaacaacaaaagctacggcatcagccaacatgatactacatttctgatgcttattagctatttcattttgaacaaatcccttttaacctgagctttatttcatcaaagggattaagtatttgcctaccagagactactgctgtttctgcacgaattcaaaacagtaaaaagataatagtcctatgaaatttgtttcaaaagtagatacagcaaagaattaagggctccttcttgggaagttaacacaatcatcttaacttcacaagccaggtatgtggtagaacagactgaagccaaactgacctagcaccacttttcccaggtgataaatgaaagaaaagccctaccccacattccccttaaaaagcagtgggaaagtaaagcaacaagggctagcagtgtgatgttcaggtagaaaagatttttgttttcttcttgtaaatttgtttgagttcattgtagattctggtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaactgaacaatgagaacacacggacacaggaaggggaacaacacaccctggggactgttgtggggacgggggagggatagcattaggagatatacctaatgctgaatgaccagttaatgggtgcagcacaccagcatggcacatgtatacatatgtaactgacctgcacattgtgcacatgtaccctaaaacttaaagcataataataatttaaaaaaaaaaaagaaaagatttttggccatccagatcagtttcaatttatcttatctcactgttatcttagaaatcaaactcaaacacatttgaacatgtggttcaactattttcagtgtcttctatcatgatgcacatggtttgcttgaatctcttcctcagcctccttattattcggaaaccaattttgcacttaacattctagacctgtgagctgttataagggttctgcctcaatgactcaaatttctgataaacagtaagtttcagtgacatccccaccacatgcccctttcaattccacacgtgcacacacacacagacagcaacaatttcctaaacctatacaagttattacttctgtggctttccccctaccttacacagaagcaatactcacaaggaggcagttactcttttaattccaatggaggtcttcataaaacctgacattctccatgctggttacagaaatgaaatagccaggcttttctggtatagaccatactttgcataagtttaagcatctgccatgaggggctatgatacccctgtggagcatgcttaggtaacaaaatgatccatcaattccaataaagatgggttcagtcaactgttgagactcttctaccatcactatccactgtgtggctgacaggcaggaagtaagcaggggacactgccaccaagaaccctgttcctcatccttccctctttgtaggctctgcctctgctccaacaactgtgggaaaatctaaaggaaatccattggaagaatgcctagttattgccctttgagaattccaattaactctcactttggagttggctaaaaggaacagaagtaacacaagaggcctgaggacaggacattcaagctctggaccttacttgggctacctacccacattccctagaccacattagatgagtaagaaatttctgggctttttgtatgaaaaaaattaaagctgacaagagagcattctacaaaacacatgaagggcattatacaaataacaataaaaaagtcatctgtgacttctcacttcaaataaggactatgtaaatgggactcaatatagatagaagcattttatttaaatgtattgaagaggtgctgataatcagatgtaatatactgttaaaacttgacatgtggctgtggaaatttccagaatacaagttaacaatgaagttaggaaaacatgtactcggtcagtctgtattttttaaaaggcagaggaacaatttactcaacgtttcaatttttaccccactcctggcatatactttttcaattttttttttgtctggataaataacagttattaggctaacatctcataagtaggtcagttaatttgaggcctgttcttccaactattacttctaaattttccaaatctgctcaaggtaaaggtttttaaatgaggggtactttgtagacgatgatttataaatttctaccctttgtaccatcacaggaaataacaaactacacaagccagaaaaacactagggtgggttgaaatgctgagaaagatgtggcgtttaaatacaaaacaaaccttcctctccgaataaatactcaaggtcaatcccaacactactctgctcaaaaccctccggtgccccttcctcacctagagaacaaaacatcagcgccttcacatacatgcgcacccagaacacacttctataacgcataactcaggctcatttcccacactcgcctcccatcctgctttctttttgggcaaattctatatggttcccctatcaactgctttaaaacttccatgccctactaaagtcatgaactcccagcattatggctattagagccactcgtctcaaacacagaactgtgctgcaggtattttaacagaggacctactgggtggcaagcccttagcgtagctttacttacattcctgcctgcataccctctcctccttctttacagtgggggctggtttacacagcatctaagaatatttccttctggccagtattaacttttataaaagaacaaattataatgataaagaaaaaccaacccaatcccaataatcctgtcgcaaaaggaggttgaactagaaactcaaatccccatataaagtttacagtggctattaaactttcaagagtgaaagaagaaggcaattaaaattattctctcttcaggagaggttgctgcttttcatcaaatcattttatgcaataaacatgaatttgtttaaaaagttaacatttcttcttaatatgcaacttagcagaccatgaaaagctttttttcctctcctaaaaagcaggtaatgaaaattctcagtgatgaataaattattttaacgatataaatggaaacttaaatggttaaaagctctgtccaagattaagcagccagttaaatcattttagtaaggtaatttagacagagtaagatttcagaaatgtagttctatattcctatgttaagggtcaagctcatgctgaacagaaaaaaaaaagtataaatatgacatttactaatgaggaaaggataagctagttagaaaaaggtataaatttaacaaaaagttaatggcaatacagtagcttagaatacaggtttcttaggtttgcttaatcactctcaaactgaacacaaaaaatagataatactatttataatattctcatttttataatagaattttccaaatgtggttaaattgtggtttatttcagtataagaaatttcatgattgtataccaattaataacttttaagcaaaggtaaattttagcctggtctatagctgaatgattaaggaaaatatttctttaatcaagaccaaaatcgggcagtttttctatggtagttaattctagacagaatttttttttcttttgaggggtcagaacttaccaataacaataaaacattctattccctgagataacagctccttctttccagataaatcaaccccagtttcaggaaaaataaagcatcctaggcccattgtagaggagggaaaagctgagagagatgctgggagccacgtatccatttcactgtgttatgtgataatcacctatccagagttctttatgcagaggagggaggaagtctacacatattcttggaaatgaatgattttagtttgctaatcatgaatttaagtctgacaccgttaacctaacaagtcaaaagtattggctttaagccataaaaattccacatactatttagatttttttcaatacttaagacccctaaaaataaaatgagtagagaaagagcatgaagactgaacacagtaggtacaaccactcacttcatgaataactcaccaaaggaaggattcctttagggacctgaaggatcttggagaaaaacctctcttcttctcaccagcatacaacttgacacttccatgagattactcccccacccccatgcctgaactgtacacatatcaccttttcactaccttccctaatgagaatcttaaaacatttttgtaatattcacactttatttaccatgtcaacactggggatactgtgggcaggcttaacccaaaatagctgcctcccatgcagtacagggatgatgtcatttcaccagcaaggtatgcctctgggacatctccttaaccaggaaaaaaagtgacctttaggacaagagaacaagtatctcgagactttaacctgtatctgctactacttaaacaaacagcatcctactatgagacggatacgttgttttcaatttctatgccatgtttttttataagcaaaggctggtgaaccacgttgaactctgaatgctaaacgatcgcccagcatgctcaagaaaaaacattaatattttggttaacagaatgaaccacaggaggattattaaggtaaaatgctagaagacaaactgaactttgcacacacaaataccaaatgtatagagaaccgccaaacatctttggtgattcccaagtgctaggccttagacttgctgtcataaattacctgggaagcataataaaaaacagaacccggaatctcacctgtggacagggatcgagtagatctacagtggatcccagaaactgtatttctaactcacttcccttgggattaagatgcaaccaaagtttgggaacaaatgctttaggtcctcacagagcctgagggacttcacttcactcaccatggaaatactgaacatctgtcatttattcaacacaccaactactgcacaaaaccctactgagctaatgctattagggagccccaggagaaactgctaaataaaccacctttcacagcacttgattcactgtttcaatatcccaataaccaggaattttaccaaacgcatactaaattctaagtggcttggagtacacaaacacttgtatatactaaccaatcttctgtacctttctaaagtaaagcacagtgtcctggcaagagttttgatataacgatcagaagacaaggatttgtttgagtcgcagctctttcttcaactgcctggtcttggctaaattgtatgaccaccaagatctccactctgactgtggacagagaacagtgcttaagcctaaattacatatgggtccccctgtaattccaaaacttctgtggttcctcaagggtaaagaatatagacttcaaagaagggggaactcagcaggagctggaacaacctggaaagacagaagctgaaggacagaattcctttagatgggctccaaaagatgagatgaccacagttaaactaaaaatgagtgtgaaagggtataccaaaaagtcggagctgcaaaagcatatgcatggacgctgggagtaagatcagcttacaagtaaagagccagtctgagaacagtggagaacggcaatagcactggcatcactcctacaaaactcagccagatgatagggtaaaacagtagagaaacaccatagagttttgagtgagcagtaacacgagtaaagtggtgctgtgtaagaaagtggtgctgacagccatcaccagtatagattagacgagggaaaaagacttatttatggaatagtatcccaggaaatgaaaaggcttaactcaacttccaaaacattcttaaagctgtgaatactagaaaaacttggctcaagacattgtacaagagcacaaaatctgtctaatggaaataaataaacatagaaagaacaaacaggcaaagggggtgctatatacttgtgggaaatggtctgctttgcctcttagacaaatgtgggccaaattgaggatgccagctgttatctgatatttttacaggaaccaaataggggcggggaaagaagtagcctgctatttgcccattaccctgacccacatctcagaaaatcagaaactgatgtcacactataaaagccacaaagctttactgtgctttcttccacatattcagcccaagcagctgggccctaaagagaaaaggctggatgatgaacagtaaggaagcagctgtcatcaactgtctccttgaaggccacgggcatttctcctgtggagacctatttcccctgcatttctaccttcttctggatcttcgtgcaggaggatatttagtaaaagaactgacacactagaatgaaataagggtaattatttctagaatggagaaaaggatagttcctgggacaagccatcttgaccacctattccattttcttcccaactacaactcaggacctcagaactaggacaaattagcagcaacgctggaaatcaatataaattgaggaaaagaaacctgcaaaaatctgctgtaggataaagagcacacggtctgacggtaactgaacactggatgtctttttaaagaacacttattgttacttaatagtactagtaaaagatctctgacacagaaagtatgcagagaaatatagataacgagaaaaagcagttcagactgaaaaaacttcaaaacaaacttgtcttacactttattggaaatctcatttttcccttcacattttgataatatacagtaaccagttcattttctgattggtgaatcttttcatagaacagtttcttgctcaagaagtatctagaattcttggacctctcataccctagtatatttgggaaccactatatactttcatttagataagacagggctggtaggcatttttcttaggggccaataaatataaagactgatgtgtcaaaaccactcagggctaataaattaccttaactggtaattctaagaaaagcaactttaaagcacaaaaatgacacttcatttccagatacctgaaaaaaatgagcaaaaatcttttacacaagtctctaagcaagatggatactacagtcagccttgactaacttcccctcaccacttcaggctatagtctgagctggtttcttaaatcaagggtggaaaataggttcaaacttgagtcaattgatagaagttgtctggaacactattttgaaaaaaatatttgggagccacatctagactctgtgagaaagagtgccatgattgactggcaatgtctgcactgggcaggagagggcaaattgatggtacagctaactaagaatttgctagaggcgacatccctcttattttctaaaggaaaagaaatctatgctgtgaattagattagctccctctcaagagagaatctacataagaatttcaaagattcacaaaagcagcaaagtatgtacaaagttatttactgtacgtcttaaaaagaaaaacaacagaaaaaataacctgtgtcatgtaagttcctccagtcagtctcctcaaagcaagctgaattagctagagcaaactacaactcaagcaccacatctagcctgccacctttttgtataacccatgagctaagaatggtttttacattttttaacttggaaaaaataaaaagaatatttgtaatacataaacatcttatcaatctcaagtttcattgcccataaataaagttttattggataacggctgcatccatttgtttatgtagtggctattactgctttcatactataaaggcagagttgagaagttgtgacagaatgcatggctcgcaaaaccttgcttattcactacccagacctttatagaagaacaagtctaaggtttcctcaagttatagggcaagtaattctctataagggaaggagacttgattccgtaggcttcctataacatttatctaagagagttgttgctctgtccccctttgcgaatacatgaatgattatacatagcactcttgaacaaacagtttcttccatcttgcaacaaacaccaaaattccactatgtctcccaggtaactgtttatatgggcccaaaaggaagaaaggaaagaactacaaataaatcttaatttttttaaacttctgttccgcaagtagatataaaaaaactttaaacatacttttattgttttggtttgaagtctcaatccattcagggtgttgatagctttctctgcatccttggggtcaatgtagttcacaaagccatatcccaagctctgccctaatgaaaaggaaggggaaaaaggcatatattagttctatactgttgacagagatcaactttcattttggcatatggtcttgtcattaacaccagcatatttcctcaacagtaaaaagaactctctattaattctagaaatatacatgaagtctttatgtctcctgtctactacattttcaagttttagaactcagcaagcagtgctgtttaggaaaaaaaaaacacacatccccaaaggattccaccatccatgccctgcctgagccagagtataccatcagcaagacaaggtcagcttcataaactgtggggataaatctctgtgctatggagagggcttaacaggcaataccttttcagcttcagtttccttagccataaaaatgggaagacagaaaacatcaaccaagaatctgtcagtgttcagtaaattgtaccctgacatatttacagcctttaccaagtacaataatgtcggagtctaaaatggtgaagaaccatgtgtgggcgtgtatacatgtaagtttattttagacgagggcttatcttcaaatacactcaatcaaatttctccaaagagggttttatgatctagataagaacaggaaaatatgaacacaaaagacttacagggatgacatcgaagacaatgagaacatataggaaaagaagaaatagaacataaacaaaaataacaggagaaaaaaagtctagagtaaaagttgcttctaagtgtttgttgttgttgccaccctccccccatcatctgagccctctcactcctggttcactgatgccctagatctcagacaatgggagctatcaaaagcagttgcatcaatggaatgcaaagataactaaagtcaatcgcaatggtctcaacttttcaatgaagcaagtttctcagtttgaaatggcaagaaacattatacaggtgacaaaaatggcataagaaaagtttagtctacaaaagtcaaaacaaactaaatgacgatttcccagatgcccaaggacggtccaaatgcttttactaagtactactgttgcatcaatttcatagggaagtgaggtattttttcttgatggggcaccgtaggtgcaagtggttatcaatgtgggtttttaggacagctactctggttatcctaatgtggatacttgttaccacataaacgaaaagagaaggctaaatacagtgcccaatatgaaaactagtgattatattttgggaccacaatcagaattttggataatcactgctaatatatgtcctctatcaaaatgtattttttcctttttaaaaaagagaaaggaatagagagctaaaaactaattaggttaatttcatctcacactaaaattgaggttttattttacagttctagtaaagagtcacatgtgaagccactgtatttttaagcattcagcttttcattaattcaaaatttatcatgtgtttactgcatgcattgtgcccctcttatgaaaatgtgttgcagtcctattgtcattgagtagaattaaattggctgaatgtaacaaaatctgctcaaggaaccagcttatagtggaaagacagacttccaataccggctctggtgtttactggctcgcagttagctgtgcaactttgaagaagctacttaacacctctctgaaccacagcttccttctctctaaaacgagggtaattcctacccaactaggttgctgatgcaatgatgaaaatattcattaatgatgaaagtggatcgtcaccctagtcaaaagataacatgagaaaaaataacatgcttactgttaaagattttaagtatattcatttaaagttaaataaaaaagatgccacaaatataacagaaaaagaaaagggcaatacaaatatagttttgtcatactgctattctatgacaaaataaatcaattgtatcagcatagtctaattgccctttctactgatagatactcctcctcctgcatcttagcagcttctaaccccagtgcattctcaaacttgactgcaatggaatcatctagaaagcttaaaaaaaaaaaaaaaaaaaactaaaacaaaaaaacctgatccccgaatcccactcccaaaaatagatagatatatatacatatatgtgtgtttgtgtctgtatatatatgtgtatatgagatgagatctcactacattggctgggccatgcttgaactcctggactcaagcgatcctcccaccttgggctctgattttatcagtctgtcatgaagcattggtactagctttttaaaatcctggtgactaacgtacaaccaccatgttgagaaatcactgccttaatggtgagaacctagctggggctacaacggggctgctgggaggtctaagaaaggtcttgcagggatgactgctgtttcacagttgcgttgtttaggtacacgtggatgtgtttcttctaaaatcttcaagttacctattacttcaaagaaacagtttattggcctcctgaggtctgtctggggcacaagagtgcctactgagattagatcactgggtaaagtgaaaagcctgtcttgcttacttcctacttagctgtttcccactctagcctctgaacccttactcctggcctgctgtaggcatggaaacatttgctaaatgaaagaatgagaaacttactgatgttatttatttaaccaaaggtattatcatcatcaccaccaccaccatcagaagacccaaccatcaaatgggtcttccacctgataccctcaagcaatcatgactagctatatgagtcagtcaaatatctagtatctgttaagttgtttatactcagaaatatttatccccaaatgactttgcctccttataaaaagtttcttatttgcctagtggcattattaggatgagtgccactcagaatatgtttgaggtaagcaaaactgtattattatcctaagcaaaataatatgaaagggggtatctgctattaaaagactgcattcctaaacctaccatcgttggtgtattaaaatgttggcactataacaaaagggagttagaactttaaattactttacagtgaaaatctgtaatcaaggcagcaaatatttattggatgtttaaaatatattaagggtatcgcagatgataccaagataggcaagcctccccattctcaccttttagctacatggtattttactgtttaattgtagcttcacattaaccatgttcggtattcagattcttctcctacaaggtagaaatgatatctgaagcttggcaaggtcaatcagcttctacaaatcaaaaaggcagggaggaagtagtaaagtcaggacttgaagtcaggactttcaaatgctgtgctctactccactcaattaactagtttatacctgaactgagacttcaggcatattgcgtataagcccaggactagtttgtacccaatatgcctgaataataacgtaaccaggcacttctgacacttttaccgcaaaagttgtttcttgtttgattactatctcaaacttctgtaccttttatacaaatatcagttttactatatatgaatttcagtgccattattcattcctatgacaacataaattgcatcttatttatatagtgcatatttctggttataaatgagcgcacagtttttaaaaataaaagcagtagcaaggcaaacattacaaaaaaaaataccttacctacccttttcccactcttatattcatcagtaagtcatgggccaccagggaaggcttggaaaccaagcatcacttatccatatcatccaaacctatttttcaagtctctctgaatttagaatgtgcatactgataatccccaaactaagattcatttctttaaaaagttttataagatgctacatttaaattccaagtacaaccattatggaaaccaacatgattaaaagactattctgaccaaaatgacaaagctaaggctcttcaaaaaaaaaaaaaaaaaaaaaagcccttaagaaaaacaaatcctgtctttaaatgccaaaaaatttgcctggtaactgaacataaagaagaggctcaatgccacgtgtcctcagctattctcagaagctacctgtggtcaagtgttctaagaattttcaaaccattaattcaaatctttcttcttttgaggcaaggtctctctctctgtcatccagactggatggcagtgggcatgatctcggatcactgcaacttccacctcctgggttcaagcgattcttctgcctcggcctcccaagtagctgggattacaggcatgcatcaccacacccagctatttttttgtatttttagtagagacagggtttcgccacgttggccaggctcgtctcgaactcctggcttcaactgatctgccaacctcggcctcccaatgtgctgggattacaggcgtgagccaccgtacctggcccaaagtcttgattttaatggccttggtagggattctagaacttttgctatattctgtgctgcactgttgtgtatgaatgccttttgtttcacacgcttctttttaatctaacatacatgccacagaaaagaaacccttcttcacaagagatagaaaaatagtttataagatgctcctggcacaaggagaacagttataaacaggctggtagaaatcatggtcaagggatctataccacagagctgaagcactccagaggcctctgaagaggaccaaagactactgagagcagggttcagagcaaggagaggaaaacaggaagaaaacccgtttagtggcaaagtgctactgtgggaaacacagtaaatggcaatatatcccaaactgtgtgtaattcaaagcatcagctattcccctgccacctacattgttttaataccctactttaattaaaattttaattgcatattttaattaaaaatacacaatcttctggacctgtttcattcaaaggtcactttatttagtcttttctattttaaattactaccaatgttcagaaaaatcaaattaccccctcaggtttaaaggtaaaggcaatagactaccgtaattcttgattaaaagtatattaactttatccaaccaatattaaacaagaccctcaacacaaaattgtggaaaataaaattttgtatttaaaaaaaacaagagtcaccctacaaatttctcatctacaataagcattcaataactatgggaaccatactttttgctaggccctgagaatgcaaaggagaaaaagatctttctcataaagcctatattctgacaggaacacattctacagggtattagaagaaaatagagctaaggagaaaaaagcagcagggggtgagagtggggaggggaggagcagggctgctgtttaaatacaatggtcagagcaggccctatcctgcaggtaacatttgatccaaggcttgaaggaactagctcaagtctaacagtgaagatgtgcaagacgttccagcccaagttctgccacacccgcatcacgttctgccagtcctaccagctaaatcggccccttgtctgcgttagcattggttctctattattctggccctgatcactgctacactatcctaataggacaacccttgcttagactcccattaattccaaaaacagccatcctccaccaaaacattgtccaggagaacttcttaaaacacaaatctaaccatactctggtttccagtcactgtcagttttttgctcacttctactttcgctcatcttccaccactcctacacatacaccctaaaatgcacattcagttctctatgtctggaacacagctctccaactagccaactcccatgtatcctttgagactctctgaagtcatttcctgccacaacttgccccatccccagtgcacactgtacagtgctcctctcgactagtcctcccacagcttcttatattattccgttatctttgttatgtgtgtctggggtccatttggatgctccctcactagactgctgagcaagggcaagcagaacatagttcctgacaaggaggaccctaagacagatcattaaatgttctgtgaatgactgaatgaaaaacaaatgaaggagcagcagcatctgccttccaggagcctgtggtttaggagatagttgcccttataaacatgttcctcatgtccctacattgtaccagatggattacagaacttgtggagacaagatgctcaaatgttatagtaattctgccttcataaggaagtcatacgagttttaaatagttcatgtaaaattgttcatacgaaaaatttctacaaataccattaagatgaagtctcaattttaaaaagtgtcatctagagtaatttgatagatttacataaatctgttccacaaatcggtaagtatgaattatgggatgtcagcatataattttgttgaaagtactttttcactaatataattaagtctgctgagactattcatgtacaagtcaaataaaatgcagagtgaattctgtaaaaacctggtagttgaatcaacaataaaaggtgactacactgattgatgtgtatctattattccatttacagcagtagtaatgttttatgaaataaaagaataaaagccgtgtgaatctttttcaaatcccacagttagcagaaacaggtcactatggtcctctctgtcaaggaagacttgcaacctgaggtttaataatgcaatacttttaaaaagcaaaatggaaagattcgcttcctccaaacacagctcttgcataaaactgcatgccttaacgacaaaaaaaagcaaataatttgatttgcaaaaacaagttttcgttacaaagggggaaaatttttgtttttaataaagaccctgttgcctcctgatatccttctctctcctccctcaaacacacaataaagttgcaaatatattgtatttcttcagatggacttactgttcttgggcactcattatgtgtgtctgttcagacaggctgtgcactgcaactctggcaccaaagcaactcgcaccagacttcacaaaggagctttcttaatatctcagatctgatacacagcaaaaccatgtgggtaccacacagcagggaaaaggtttgagagaatctcagaacagagggatgcagttctctctagtcacgtttttctccacattttaattcctgacttagcctgagtctcctcaaatgtagcatgccagatgcagcaggtccttccatttaaacactcaagttaaggtgggtcaagttaaacaggtcttccttgctgccctctaatgagtaagatcaaattgtgagatggaggactggtgagatcctattactacagtccaagccagccttcctgaaagctgggagcatttctaccagcttcccaaaggacattaccagggattatcacaaggatggagaattcaacctagacactcacataatacagaaaacagatggctcactcgaagactcatcttccacccaaatgctaataaagctggcctgagactgaaaggccccaaagtttctaaatgattttcaggactttacagatacatggagctaatatagaagagtttaaatcataacttttctgctgaaatcaaagctgcaaatagtgatcatttggtaaatattacctaagcagcctaattctagagagagcggttaatgtcctcagcaccagggcattttcccttcaagttaattttaatagccatatctgtcccctgattatgcaactggtagagctctattttcctgtagttccagtcccagtaattatgaatctgctggcaatgcggcatgaccctgcttaagttggcgatactgtgggttcttaatatatcacattttcagacaacattaagaactcccacacaattcagtcttagactattgagaacagaaacagcatattaaatcctctaaattcttgccaagtattacaccgggtacacaaagatatcttgcatccaagaccaggaagatgaggaaaaattatgtgcagtaggaaaataaaccaattcctctacaacccacaggatgagactctacctgaaagcaggttctccagcctgaaagaaagtgactgagatagtgtagcacgctcagcaccacaatgaaaacaaaaggcggttctcatcacttattgatataggtagtttctctaaaagataggtcagcagttctaccttcaaacactggagctgccaccaggatagagcaaatgccaaaataccttcagatagcctgaaagtcatacctgacagttcaaaaaaggttaggacattaacaactctaggctagtccaatctactttcaattaaaagtttgggtatgctgcaactttctcatttctttgttaattataattaattctacacagatccgccaccgcccctacccccacccccacacacactaacagtcttatattatctgctttatcttgtgtttacttaaaagacaatggagttgttcaagtatataccatttgggatgaaggcaaaggaactgtattcctcaaaatagtattgtggtagaggaaaacaagttaactgtggtagtaaaaagggcatctgctgttgcttgtgcgaccagctggtgtcaatcttcacaaacatgcactcttgcctgtgcctgcacacacacacgcacacaccccccccactaagcagtccatcaagaggcagtacagcttcttaatgtgtttttctctctgtacaagatcattttttaactcagataccacaagaaacaaaaaatttaaaggccctgttttgaaactatgtcagagtccctgcaaaccaccatggagagctccccattttgtcaagaacgggaaactataaaattagactctaacaaactcaccaagtccatgtgaaacaaaaattctcgttagagataaattttcttcttgaacacatttttcttaaaaaaatcactctctcacccaaaagttaaaggttcaccagcccaaaccttccagtatgaaaaagtcagtaagtttgtcggggaaaaatgcccattcccactgccccataaatgctatgtctacctgtctggcagtcaacagtaccactgccaaactaaactatcaagcaactaggatccttacattacatatatcacatttaattctcaccacaaggctacatgtaaatacatctgtatccattttacggacataaagttggaggttcaaagatgctaagttaacttgctcaagggcacacacagctagctcaaaggagcagctgggtttccacactacaatcaacctttccaaactcagtctttcaaaagtgtacactttgttgcctttggccatgtgtggaaattactttgtggcagaatcctgtacatccaaagtttacaactttccaatcagaatatttataatctccaaatacatctgtatttttttcttgttctttgtcatgaaataaattgactggaacttcaattctttcttaatccatccaagagactatctgtgaaagaaaaaaaaaatgacctgaaagaaaaggaaggacatcctgcaggtgcacaaaccacttaagcccccaaaacaaatccatcattacaaaacagatagatgagaggtatctgcattataaaaagatccatttaaaatgggccttgatttacatactccttttccaaactcagaaagcagttcttatggctaaagccaaacatgtttgctactgccaaaacggtctcccacacaagacatttctctcctcagcagattgcattaaaatgctttcatacgcatagcatgatttcatagcggtggaaaaaagatgggatcaataccacatggtctctgccctctaagatgctcaaaaattttaagcccaacacagtaaacaagggagagaggcaggcacctaatgaacatgaaatacataaagtgcatcgcaggggtttcaggcttaaccaggaccagcttgaaaaagagaactctttagtgtgtcaaaacagagaagatgaaattcaggtgtttcctgacaaacaaattaaggtaataggaacatggagaagaacaaatttgtaaagaagtataaaagagacaagccaaaagcatactacgctgaacgtaaggcatctatgtagaggtaagcaaaccgaccccccatcctggaagcaagactggcccatgtgaaggtttacagcagacaaactgcaggatgcaccaagcactgaggcacaatgaggaaggaggcacacgagggacccagggacagtcaccttagtggcctggtataatcactgagcagatgcagatgtaagactgtaactagggacctcagtgttagaaatcacccacattctttttccttcttccctcccctctcaactctttattccttccctctctagacactcccccttaggcaatccatgcttatctacttaggctcttaagaaatcccacaggctaatcttgaaacaaaccaggaacagagtccccactgcaaaatcctcatgattaggaggagtcataattagtccaccaccactgagccaaagtcaagataatgccaattagaccttcagacacctgagagagccactgaacaagacacacagatcctgcaccacttctgcacgtctcccatacctttctccctttgaaagccctacggtaaatttttaaattgaagatggtactttagaatactagtttgccatcttctcagtttgctggctcccattaaaaatgcttttccttccaccaatccttgcctcttgtgttctggctttcaagtggcaagcagctgaacctgggttcggttacaggccttctagagtaatggccaggattgaaacctagcaactccttgtgtcccaggaggatccatacttccttggcatgataacatctggcctttgtaaaagtaactagaagggcaagaaaccttttgaaccataatacccagagattaatacaacacaccaactcagcagccttgaaagtattcttgcactataaaactaacagatatggataaccccaaccaccaaaaagctaaacccaagatgactacatcaggcagggcttacgattttctgagacctcctttacacagctgtaaaaacaagtacctcaatcctctttctgccccccgaccaagctaagctgctattatgagtggacaaagtgttaataactaccacagtaaatggggaaaaactactgcaagtgttaacaaaccttatttttaactgagtagcaactgcaaaattacacatgccttgtgaatgcacgtacatacctacgtccttcgcatacaatatggtgacatcaagttagaaaaggagtgaaagagggagggaagctgagtcattaagaagggaatattgggtagcatcacatgatcaggtgtttcaataaaaacatatttcaccttatgtgtactgatcataaagtatctgctatagaccgatatgtacaacccttccaccggggggaaaatgtccactgtaattccttttatatcaaaaagaaagagcagaattaaattagaggtatttttagcaaagacaaaggaagtaaatttccaaaggacatccatcgtccccagtcgacacaaggattaagtataaataacgtgatttttcttctctttgtacaggacatgttgcttagtttatagttaatgaagaggtagttaatcaagagggtaggaggaacatttttctttctttcctctaaacttaaaatagtcacacacagcactgatttttacatgcttaggaaaaattccaaaacagactgatggtgtttgggctggtgggggtataaatgctgagtataaaggaaacctatttaaatactacagacacagcttcacaaacctcaagaacactctctctgaagcaataaagaaaaggaatcctaatggaacacagtccccagaggaaattgagctgtacatggttaaagttgtaaaggctatgggtcagatgggaaccatggctacgaattaagtcaaagaggtaccctgacagaaataagtatcaattttgtttttgctcagggacagcttatgctacagcaaaccactctgagaccacagggcaacttgcccaccaattaacagatggctcctaaagagaagtacaaaatggtgcagctcctacgattgccacattcatatcacacataagcatttcttcccaaatcacctcatccaaaagttgaagtgattagctattgtaatcctccaaatttaaaattcacggatactttgaggaagattttgctaaaaagattttacctagacaatgattcattaggacacaaaagtaatgtggcaccatccacatcagcatggtatagtaaacgcattatcctgccgaatgagcagagcacagaggcttgtcttgtcttttaccactgactttaaagtatattaaaaacgaactatctaaatcatatacccagcaacttagtacatctgaccattgctgctaattctggatacatctttcctatgaaacaggaaaaacctaaacacaaaaataattttaacatattaccattttatcatctcaagtactcttaaatgtataacagggtagagggttaaaaaaatcttattcaacaacacttcaattttaattcatcttaaaaacttttaatgtgatgctttctttaatctgctgttactgaagttactcgatttgcttattcacatatctgagacccactcttggggaaggcgctatgtttttatggcaccagattaaacaatatgaaggaccatctgatgtgggaagtaacttctatacacagagcttctcagctatttgggccacattacatgcccacttggcaaacacattttaagattaaggctaagacaagtggatcagaagaatccatcttattaccacaaaggggtccctaaggaaaaggaggttaggagtttaaggcctccagctaactagccttatgaatttgagattgggatctcatctgtgggaaaagaaactgcactaaaggtactctctgatgctcgcccccacctattattctaccgtctccaccttaagtttcacaaatagattctgatgtgcgtgttagaatcactcttgttaaaagaggttcctacaatgtagaatgccatacaaaatgttaggtattcaattacaagtacaccactcgaagaaatgaatgttttactaaataactagtttttcagctcattccaatattcaatagcctatgctgtcaagagttttcctattttgttgctgaaaacttcttccttgctatttctaatgaaggaataaaatagttatatattataaactaatctcctttattcagggaaaaactttaaatatgtatgctgccagatcacttactagcccctgtacccaaacagaatataacctattaagtgcttattctagttatcctaattgacaacaacattattaaggattctacttagattataaactttatttttctcaagcaagagtactttctagcaagaaaacatatatatactgaaatggatcttaacacaaaagcctactatactattttgggcttctttatccttctcgcgcaccccccacgaaaaaaaataaaaataaaaataataattaaatctaatagtaaaggaattagaacttttacctcattattccctacaaagctaatttgttccttcatttgcactctctgtcattgtaatctatgacttaaagaaaatgaagcaaaaaaattcttttaaaaataaacaaaccaaaaaaacaggctgggcacagtggctcccaaataccagcacttcgggagtctgaggctagaggatcacttaagctcaggagctcaagactagcctaggcaacaatagggagaacctgtctctacaaaatatataaattagctgggcataatggcacatgtctgcggtcccagctactcgggaggccaaggtgggaagatcacttgagcttgggagcttgaggcttcagtgagctgtgatcacaccaccacactccatcctgggcagtgacagagcaagactctgtctcaagaaacaaataaaatacaaatcaaataaccaggaactatggtagatttttacaatccccaaagaagaatgttttctgaatgtataatctacagccaaattaagatattatacaaagattttctgtgtaatcctctataacctggtattatcttggccaggtcattcccctgccctacccaccaccatcttttcactttaagctacctgaacagatatcccattcaaatcctttaggtgtacacaaacatcttaataggttgcaaagaagaacacaaaattgactagattcttttttgaacaattacatttacaattcaccatcaatgacttacttgctgggaaaaaaaacatactgtaataaaggtaaaactagacttgcatcttttcaaggagaaccaaagactgtccaaaaacctaatgatgacatatactacttatcccataggacacagaaatataatgcctgtaagcatacacatgtccctacatggctggaaaccaaaagcgttaactgaagggttttaaagaaatgaccactaaataagcagaggagataaatgtaggtcattcagaggcaaatctgttttaccacaagatatatggctctccttagctactaaaagcaatgggagtcaccaaacattactgacctctgaagactaaaagctagagatgaaacattcaaaaagacctgctgtgtgaatgctactgctagtagtcatctcagtcattcttcaggttgttcttgctcacactcagtgagcaaagtagtgcccaagaaacataatcaaaagggggaggaagtcacaagagatgacttggaagggaggatcggtatcttcactgcacctactattttcaaaattaaattcaaactttgctttcctccaacactaacaaagtgacacaaatatgagtaaattgtttgaaaggcactgacaagtgactttatttacaaaatatgcatacatacatacacacctctcaaaacaaactcctttaccaatagctatggcaagttcacaacaggggcttctaaccaattacaaaagttattctcttataggtcaaattgagaccaatacaaaattaataagcttacttttgagttaaaaaacactgatagaaaaagataaaaaatatgaattacataaatattgtttcaatggagttctagattgtacactgactctacctaactggcacaaagaaacacactggaagagtcacagagcgttttcagaatgagtaagggctgggaaccagacttcaaggagttaagtagtaggaagtaaaactacccccacctcagaacagagaggtgagtcatcatcaccatcttatccttctatcacttccttgagaccctaggtcctgagataaaatgcctaattgactttacttcggttccttactggctgcttgcctataggcaggcagaaagagagaggacccacccaactggcttctggaattagctttttcccatcagcaatatactaagaaagagaattccccaatacagaaggaccctaatgaaatgtaagactgagacaagtttgtcttggatccacgaacatccttagaagtctttccatgtaaactgaaaaagaaaaaaaaaaaaaaaagcctctctcatttctgttcaaataaatgactgcatccaatattaatcatcaaatgaaataatcaacaaatcattagtggaccagactatactttacatcttcgctcaacaaaacaagcaccaatttagaacatcctgcattccaccttcacagtatgacaattccctccttctctacctcccttgaaccatgaggtataccacaagaagttccactagccgagtacagtagtcctccaccccctaccttatccttgggggttacaagaccctcagtggataactgaaaccacagatagtactgaatccaacataatatacactacttttttttttccgatctgttaagatggattctaagtgattaaaggacagggaacatgtaccagccatggataatgtggacaaagggatgattcacatcctgggcaggaaggtgcaaaatttaatcacgatactctgaatggtgagcaactcaaaacttatggattgtttatttctgggattttccatttaatattttaacactatggttgaccaccagttaactaaactgcagaaagcgaaactgttgataatgggaggactacggtatttcatggcacaggctctcttcaacagatagtcaccacttgaaatcaagaacttaacactggctgatattctccagcacacccaaagctcagacaaagactactgaacaactggttaagcttgagtcatctttaatcaagacaagaccttacagctccagaggtagaagaccttcctcatctcaatcagaggcttttggaaactccctacaaacatgagtgcaaagtaggcagtggggataagtctacacaaagcttgcattaagacttacccatgaagtattcacctttttcattattttaaactcttacaacccaggggaggctttctgttaagccccaacacaggaaattgcttttcagttgtcaatagccaacgtctgaaaataaatccagtcactaagtgtggaatgatgtacttgcagccaacatgcatttggctgatgccaacagagaaggcaggaggccaagatataagacctaaatttttttttttaaaaaaaggactgttctactcagtaacagaatctgaaataatgcaaaggcagaaataggccacaaaccacctgcctctctagcttcaacatacatcagcatctgtctcccaaggttgcttcagaaagatatttaagttttctctaactacaataattgttccagtggtctaaaaaaaagaaatggctctgtcctgtgggtttctggttgggtggttgactgttatattgatggggggcttccttgaggggtagggggaaagagtactagggaagggggagaaaaaaatggaagaactaaaactacagaagagaatttctaactcgtcgctctttgactctgattgaggaatggctttctgccaagatttccttcaagtgctcagcagagaatgaagtgaggtaacgagaagtagtctggggatgttacacactgtgtcctgtgtcccaagaccccacacggatgtttgtccctggatgctctgactctctgggagaaaagagtagaaaagtatgaaggcagagaagacttccagggagcaaaactacttgggttcttctttctgacccactgtacatacaccaactgcctcttcctccaggtaacttgccaagatggggagtgataagagattgaaggcaattttcaaaagaataaaacaagcttgaaaccaggcagaacaactgcaaagggggtaagatgaagtccctgcaagtagtcagcaatctggcaaaatattgcacaaattcagtattttaattggacgtttcttttacggggaatgtggcatgaactaaatttgaagccaggctacttatttcagggggaggggttggtccctaaagccacttggagaggaagagaaataaaacatacagaagagtctacagcccaaggggaaaaaaactagtatctcctgaaaacaattatcataatttactttcaaaatactttggtatatcaaatgttgtatgatttcatttatatggggtaccgagaataggcaaattcatagagacacagaaaatataatggttaccaaaggctgggagcaaaggaggtgggtgaggagttactgtttgatggttacagagtttctatctgggatgatgacaaggtactggaaatggataagggtgacggctgcataatactgtgaatgtgcttaatgtcactgaactgtaaacttgaaaaggttcaaatgataaattttatgttatattttgccacaataaaaacatttctttttaaagtttagaattaatctgatgacacgtgtgcaccagccatttaagctttaattctgggtggtcatctaacatactatcattaatgcacaatccaggattagttaactagtataatacaagtaggctaaaattcaagtgactagtgtaagcctacatactatccatacctaaatcaacaaccaattctctgctgattcacctaatggatgtcaaaatagggttttgttctgtaagccagttatttgttaattagcataacgagtgttagaaatggagtcttaccggtaaaattaaaggagttcaagatacgcagatgggctaaattagtttagagacacttcccaccttcgtataaacagggcacaaaatccaaggtggcataatccaaggtggttatatctttatggagagaacccctaaatgttaaatggtcctgggtttcagtctttgtttaaagggatttctttttgcatgatgcaaagtgagggtgcagaacgtgacttttgggatattgttagcctccggtgaacatttcatttaaagtgtgttcaaagcacttaaaaaagaagagagaagtgggactttaccaagctttcagaaaaggcttctccatcaatttggtcctgcttgctagatagaggtttctatgtgtggtgggatctggcctgagaccttctttcattataatctatagagcaactaacgctcacccttcctcctttggtgcctactaacaactacgcaaaattacctaagagctgttattcactatactaacaggtccatttaataaacccagtctcaaggagtcactggtcatgaacacagtggcctccaagggtactgtcttaaaaaaggaaaaaaaaaaaaaagactctttaaaagtcggttgtccaactataaaggctaggaaagaatattagacatcctccttactttgatggctatatccaaatatattgttttctataagcattcagagaactaaaatatcaaatagagtaagaaactaaccccagaagattccatattctacttttaagtagcacatcaggactagctttgtatgttctagagctggggatataatggaatgttatcacgcctttttgcaaaggctcccaatttccagcacttaaaaaaatacacatattgatataaaacacagtaacaaatcggtattaacaattctgtattttaatcctattccaatatgtataaaagggcttacccccataaaaaaaggacaacaaataataaagaatataaaggtctaaaaacaaacctggtataacattgttagattttaagatattagatcccaaatcattctacttgagaaggtagtacactgtctgcaccatataatggcaaaatcacttggcaccatgtttaaaaagagctaacctaatactcaggttcacaaaagaaaaaaaagacaattttagaggcaggatttgggaagtcatttaggagagcccttgtctacatgagaagatgtcaattgatttgatacaccatcagtctctcatttatattcaaaatgtttagatacatttaaagtagaataagagcaaactacaattcatttaaatggaatgaaaaaagctcccatggcttacttagtaccagggttaggaaaaaggattcgtacgacagtacccttggaggcaactccttaagactggatttaaagcattaaaatgtgaggaaataaaactgttctctcaggctccagtgaccttaaaaacagtgcagtgattctgatttaccagtttacacacagctatgcctcccttaaactttactttaaaaggaggatttgactttctcagtattaagtccaaaggtcaaacaggttgtaaagagtcaagggccccatcagatctactctacaaggtaataaacattcaagtctatcatccctcaccaagaaatgcaaatttttgttgagctagaggatgggagttgggggtggtggatacaggacttgtacgccatacacattttccctacaaaatcaaagcagtatgtacaaaacagagttccaacaaaaagtacaatgatgagaaaagaactcattaagagctaaaaataaactctaattcacaatatgcataaggatttaacaaaaaaggaaaacaagatgtaaaattgcatctgctaagttaaccataccctcatggaaactgccccctcccccatacacacaaactgaaatctgtaaagtctgtgatgactgaatgaagaaatgctttagatgttttcaatgaatatttcaatggaaaagaaaacaaagggatagtaatttttttcctcagccttctgatctgctaacactgcaggaatattaggtttttgaacatcccaaaacacaggtctctgtatatctagacttgaacatcatctttgataaaatgagactatttagtatagtatttacgttttatattaaacggatactcatcttaaggaagatgatgtcaataaaagtaaaaataagccgcagttggtttttatctaaccaacacttcatggctcaatttaacaacttgctgaccttcgaaagcccagtaatagctcactggaaagctcacttgagagcaccttcatattttaagtcaagctaattcattctgaaacattcacacaataccacatagagcaataattccacactccggtgctctagttcataaaggctggtgtaatatcattaatcatcattctgggctcccaagtcctgcctcgcactttctattcttactttgttccacccctggaaaatcaattatgttggtcaaatcacctagaaagcaaaggatggaggatgagctttgcattcttcccacatcatgacaaactccaagaaatctaggacaacagatctacttcaagatgtttttcaaaaactactttttacctatggggggaaaaacaaaagtctgcaactgtcacgtaactgaatgggtattaactggtaagaagaggacaggaaagagagacagtacccctgtgtgctaggtactttatgaaagaaactgacgttcagagtcaaaaagcacacacaggacacaacacaaattgagtggctaggctggaattggaacccaagtgtaacaatgttctaagctaaaagctctaagattagtgtccagtaggccacctccctagcaggaggaagcaaaggtattttgattcaaacttaatcccaagaacttgatcccaaactaagtaacaaacctagtgtacacaggggtttagtaaatcctactaccacttaagaaacttttttttgttttttttttttgagatagagtctccctctgtcatccaggctggagtgcagtggctcactgcaacctccgcctcccgggttgaagcgattctcctgtctcagcctcctgaagagctgggattacaggcacccagcaccaagtctagctaatttttgtatttttagtagagacggggtttcaccatgttggccaggctggccttgatctcctgatgtcagatgatctgcccaccttggcctcccaaagtgctggaattacaggcatgagccaccatacccagccaaggaactcttataaacacagcttaaatacttctgtcttgcttttttcccccttaaaggaggcataaggtaaatctttgttctaatttagaacaatacagaatgatcacccctcgattacataaagatgatatatggtgtcagaaattactgagtggagtctgaaaagatggttttaactgcgaatctgtttcttcacaacacttagagcagcaaatgctactctgtgatttacagcccctcaaaaaatatttgattacatttcccaacaccaataaaaggggcatccaagggttttgaaatattgacaatctaaaactttaaagagccaaaacaaataccttaaggactaaaacatgctaattaagccactgtatagacctgacaaatcgaatgacactcaaataaaatgccagaaaatatctgttaaagttgaccttttgagctggaaaagcacactctgagggtttccacagctctcaacgttcagtagcagcagtgtactcagctgaaagtcaattaacttagaacaagctcaaaagaagttggcaaattttgaagcacagttttagctccaataatcaactattctgttcaggaatatttgaaaggaaatgttccaacaggtacagaataaaagtgcttcggtctattctgaatttaaacaaagttaaaaaaaaaataaaaggctggtggccaaagctgtgtcatagttaaggtagtgaaatagaatgaaaactgtcaaaaacaggttgattttgtactacatcataaaaatggggggtataaatcattttcataccaaagaaacagaattttaaaattctataaactacaaaaaaaagaagcaacaagttcatatcacaatttaactgttttttatcttctaactgaactatttccattttagttcaccatcttcctcatcgacattttccatcattcctacgacaagcgcttaaattgagaatggtgtctcttctataccaccaatctcctgatgcaaagtaaacaaagactaccccccagaaaaggtctggaatagcaaacagcacacgtgcactcttatgctgaattataaaggggcaaatgttacaagagaatttcaactgtaattttattttctatgaatttgaatatgtttacaaagtttgtgttttctatcaaaccagcaaagcaacaaagagaaaggttactgaagactattcctaatctactggtaaggcaaatacggctattctaaaagttcctctgataagggctaggaaagcacaaaatcaaaactcctaaacctcatttacaccataggttcaactttattttcccagtaaacactctaagacagctgttggaaaactgtataactgtctcgtgggagtgacacatatttttttttacattttattctaacggaacaaaataccaagtaacacaaatatcaatatcaggaaatcagagaaacaaatctggatgattaatgaattactagagaagaatattgtttcatacttttctgtatcctcaaatagatgtttcttcatcctagcaactagccattaaaggcttcattaccacaggttatctaaagaagcagctctttgatttatgaagagatgttaactgggaattaacttactgaatggtgaaaaggtccagatttgccaccccaaaatattccactttggcattaagttttttttttttattatttttttgtgaaatggagtcttgctctgtcacacaggctgaaatgcaagtgcggtggcacgatctcagttcactgcaacctctgcctcctgggttcaagcaattctcccacctcagccttgtgagtacctgggactacaggcgtgcagcaccaccacacctggctaatttttctattttcagtacaatcagggtttcaccatgttggccatggttggtcttgaattcctgacctccggtgattcgcctgcattggccttccaaagtgctgagaatacaggcatgaatcactgcgcctggctggcatcaagtattattttaggctgaggaaaataagaagtcaacagatgcaagatgagttctctgccctccccttttctccctaaaagcagagtataaatttcccatgggaagatgtctctctgtcctgtaccagttcagaagtaagcgactcattacttgagacagtcaacatcagattgtttatgcatacagttctgtataaaccaaccttgttaaaagtgcccttatcttgtcattacttacccctacatattttctgaacgcttccccatgatttcctattccgcaaagtccaaacctttcctttgttaaaatggtatataagccccccaaccctgaccactttagttttataatacttttctgtcaactcccaaacacaaaatacgagcaaaaattgtgtgccatttctccaattaatttccaagtccccaggtactaaacaaaagaggacagaagttgtttttcctaacaatgataaagaactgtactgtatttgatttcttaaaatgttacaaatttctagtttcatcatcctgtaatctttccactaaactaatcaaggctgacactgaaaattgttctataaaaatacccaggttcaagtaaaaagtgaacctagaagaataaatgttaaagactttctccaaaattttatatgaagcttctacagtgataacaccaaattttttaaatgactgcaagacctttggcaaagaaacaagatataatgaaaaaataattaagtttaaagatacatcaatgaagatataaataaagtttctccattaccttttgcctatgagagatgttccaaaaatagaggttccacaaacttgacacaaatttcattttatacaaacttgggcactaaaatctaaaaatagattcaaatgtactgtattccacagttaacgcactgcggaccaaagcatttacccctgtgcaggcatctcctttcctacagacctaagaacacacacaacctttctgccatctttctaattaaatagcatacagagtttgcaaagtgaggtgtttattaagttaccacccacccaaccaccctgctgtttccaactactggtctgcaagaatcagaattcttgatctcttgatactatggacatttcacatgctcactgtacaactgtaactgacatacaaaatcacattttcaaattaatgttcatcaaaacagctttgtgttcactgtgattgactcataggaaataagtgctattaaatttgaaggttcccattagtctaataaaataccacttatctgtttcaatcctgaggagctaagattgtatttgtttaaaaagaagagaatcctatgccattaaaatagtttggaaatcacattattttgatagaataaagaaggatcaaaactagctgtaaaattctcagcaagcagagacacaagataaacctagctaagaacactcatattaataaaaaatattttaagatactagccctaaggcgtgctggggcatggcaggagccttatcatgcaaggcactacctactcagaggtaatcaacatctctttgggccctctggaatttatatttgggtttttgttttttccccttttgtcaaagtttctagttagcagctgatgaggtcagtacaagacctacctcaaacaactgagagtaatggtgaaatactcattacctgaggtcttccaccaactactcctctagccattcttttagaagaaaggaaaaataacagtgaaagaacaatctaccctggagtttcaaaaacctaattacacttaaacacacacacacacacatgctcgcacacgtgctttcagcaacatatcagatcagtaaggacacagcctagtgacgtaaactcaacatgtctagttctgaaagctaggaattaactcagagaccaatgctgaagaggggacagcactttaaacttaaactttccaaagaattaagtactgcaattgttaacacctcttccataacgccctaaatctagaattcaggtaaacctggaaatccctggttcaatctccctacaaaatgtttaagacattgataactcctagctaacgagtaccttccaggtccccactacagattctgattcagtaggcctggacagagcccaggaccgtgcatttctagcactcattacaagtgattccaatgcgggaatcctgtgaccatacttcatgagacacagtctgattcccaaaacttttttgggcttcaagatcacctgggaagctctctgacaacagattccaaaactcccttaggtgagtaggtgaggatgtagagccaaatttgggtaccaccgggctagaatatcaagttcacaaccatagattataatgtttctagagaagcacagatgttcttgttcatttggtgtattcgtcagtccttactgtcaaaaaccttccattctccttccagagaagacacactcgccagaagatgccctctggataactctgtaaaaatcacacatctctctataaattcatcagttggccatttgcttcatctttaaagagtgagctcttgcctccaacaagtggcaaagaggaaacatccaggtaaagcataagataatcagaattctggtccctactctaccgcttaatagctctgtggccttgaactagtcatttcacaaacctgggcctctcatcacctatgatgtttggggcaaagaagggagagggttggttaaggtcacctctagggcttttctgactgtaacactttattactcattccttgcatcataaaatccatttcgttcatctagaatgcagcatcagcaggtgtcaaggactcccaagtgcatttaaaaacgcaaagggatggactaaagtcagctaagctgtacaagcagcagaagcttctcatgatgaatgcctatagataggaaacaggctgaagcatacagctgggcagaagcccaaagagacggacctgacaaataacataataaatagaacttagtctagagagaagattattgtatttgctactgaagacatttcttaatgtacttccctaatcctcactcgatcaaaatagtgacattaatttgctaacactgacacagtctaaaagttatacactctcttcaaggacttaagaagcacacactttcctaactagatatttttgttccttagatatagtttcctgattcagcattaagaaagatttaagaaaagggaaaaggaaagatttcaaatcttcctgtagagtgactccagagttttcctgtaacccaattaacgcacatgctcctacaaaatcggaatacagaaatgggtcccaactgcttcccaggaggtagaataagctggataattagagaaggaccaaagaactctggtctgtccctaaaatacgtactgagaaactgcacaagacgggtaatgctacacaccacaggacagggtccaaagctccacaaattctttcaaaaccttgctagagatacattagtactacctcttacgaagtatgcctacttttcaaagtacaaccactcagaacccagatttagatactaccattttctagactattttactcaatagaagtattcagtaagaaactcagaaaaaaaaatatcctaaagcagtttatgcttaagttaaatgagtgagatccttctaaaagccattttaacccatattacaaatatgtcagtggtccaaatcaaaccaagattaccagaagttgagatgcctagtgttcagatttacctactccacttttgaatttattatcatatatgtttcttttaggaatcatgctcatatgttattgatgtgaacaggttaaactggtctgataaccagttaacaacaaatgatttcaaaagcttttatagcaccatgttcagtgtaatctactgtcagggagagatactcactcttcccacagtccccaaataggctctatgatcaaataaggccggggaactataattcaaacaggttttctttactgctggatttttcatagttcttaatacagtgattatcgagtatggatcttaaataaagaactacagagtgcagcacttcctaaacttgtctgtcaatataatacttatgttaagaaataattactagtatctcaccaaatgaaggttgaaaaacatctttcaatcttatacacactatcgtgggaaggcaaattaatacaccaaatacactatgaaaaatggtatgaaagttcctcaaaaaattaaaaacagaactaccgtatgatccagcatccccactactgcatgttaacccaaaagaaatgaaatcaatttgtcaaaagggatgcacgcatatccatatttattgcagcaatgtttacaacagccaaaatatggactcaacccaaatgtccatcaaccaataaatggataaagaaaatatgctatatatacaaaatgaaataccattcagccacaaaaaagaatgaaattctgtcatttccagaaacatgggtcaacttagaggacactatgttaagtgaggtgagacagccaaataccacacgatctcataggtagaatcgaaaaatgctgatctcattggaggcgagagcagaatagtgggtaccagagggtggagaagagaggaggaaggaaggagggggccagatggttaatgagtacagggtcactgttaaaagaaataagttctggtgtgctattccacagaagggtgactatggttagcaatattgtatagtatacttccaaatagctagaagagaggattttgaacactctcaaagaaattatgaatgtttgagatttggaaatgctataataccctgcttgatcattacacaatgtatatagcatcaaaacatctcactgtactccacaaatttgttcaattatgtgttaactatatacaaatatatactatatatagtagtgtacacgtaatatatatgtgtatacatcatatatagtattatatatatatatatatatatatatatatatatataatgtatagaaacgtcttacatctttagaaacatctttcaatactcatgaccattgtggaatttcttggggactctacttgcttaccaaatatttttaatagaaattttaccacagtggaaatctccattacatccttcccctcaagccactgaaaagacaacaggcaggggtcagaggtgaaggaaatggatgagaaatatttacacagttttttagtatctaggtatgtattaaagaatacccatgtgttgtgcttctattaccaccgtctaccacactaaagttagagaggcaaaggaggtgaagataaagaactcaaatttatcccattttgccacataacagctctaaagattcacaaaagagtaagattaattcaagattgactagaggtgagacgtgaggatctgtaagatgtctcctgtggcagatgcctaatatgaaagatgtatgatttgtctaatattttcatcttataaaatgataaaatgtatcatttcgtaacagtttcataacaaaacatgacttttgtgctctgttcatgcatctttctttttaatagtaaggggagctctactaagcaatcagaaattgcatcatttgtgtcatagccctcaagtcatttatcatatttttatcttttatattaaaaaggttgcaaaatccacatgtcaggggtgttgttttactttaaaaacaaaagataacatgtttaaaacatgttaaaaagatgtttaaaaacatcacgacagagacgtaagagcagccttttgttcttcacctttttcaacttattaaaaacactataaatttcacatatgcttatcacactcattttggaaaagaaattgaaaaatctcatccatctgattatcagtgttcagaaacataagaaccaccttcctaatatcatagtgaacatttaagcaacataattaaaatataatggccgtttgctatggatcaatgacaatcagtttgtacttagctttttaacttgatttcagtaagttgtctctgtgaatctcaatctgtagcttgaggaaatatgattatgagccaagtccaggggctggctctagaactcacttgcagatcttggagagaatgagccctaacgattaacggaatagctcaaagtcccatgtatgaaaaagtcaaaagtgaacttagaaatggcccagtgttaccccctttttctctgccttttaccttattttgccaatggaaaccagaagtctagggctgacttatccaatgtcacatgactaggtgagagttcagactcctggtctcattcttcacactgcctttaagtatcttttactcatttcaaatattccattttatatttttggttataagctttgtaaagcaatttggtatacactatcaatcaaatttaattaacatgaaaagtccacagagtctgtctaccttcgtatatttttagtgtttaacttcatatgtatgtctaacttcatgtatttttagtgtttgaaaacaactcctgcaggaagcattaacccttctatcccaagaacgtgctctttaaattaggttttggtttactctaaaaatttagtcaaatcttaaaaaatactaaggagattttcacctaatattcaaaatgtactataattaaggctttatctttataacaagaaggacaatcatataccatgtcctttccttgttaaggaacggaacataagatctcatcacgcttggtattatatcagtgaaaatgtttatacactgacaatgtgaacattaccatttattttatcatatataagcaaaatgattatattaacataaggaaaacacattttaagattttttcccctctcccaaacacatattgtatctcactgttgaaatgctaacttaaatacactcagggtactaaaagataaaagttaacatgacactggctatcccagatacatatacttttagaagattttccaaagatcctgtccagatcagagtacattaaagtccagttaaaatatatactgcccccaaaatagtttatgatttaaaaagaaaattttaaactaagtttcatattgctgatgtaataacagagagaaaatctagatatgtaaaattgcagcagtgaattatttacaagcagtaatcttattattttctcctatcttgagacacgatccgttaaatataaatcatctacataaaactgcttacctgttattttgtctcttacaagcttacaggactctatttcaccaatgctcccaaagagactctttagttcctcctgtgtcatgttctgaggaaggtagttgactattaagttggtcttgctgtcttctgtgttcccagagtcaactggtgacgaacagttgttgtttatggtggttggaccattggctgtgttattgcaagttggcccattagacagttgtgtttccatggcagcaattacctgctaaaaacagagaaaacaagaaatgtcagaattcatatttcacaacctattagagactccatccaagaatttaaacacttgtcactaaacacaagtcgttctaatgaaattacaacaatgcttcaacaaaaagtgtaatacctacactaattttcacttcatattaacctattcatcttaaggttacaactatattttcacatacatattccatacatgcatataagcacaatttaaatcttaaacattttctagaatcacattctgggtctattcacatatccttactcacctgcagtgtccacagatgagaaaatcaagtaccaaagggcacagaattgaaccctaactaaaaatcatactagaaaataaaagtgcttaacatgctacaaaaatgaacaaaaaaatgacctacctaactctgaagagattttcagttatcctaagaggttcaatattctaaaactgacagatagccattaacttaaaaatcaaagagcaagagtacttttaaaaatataaatttgtcaacatgtactgttttggttacatattgaaaacgtttttgatggacaatatcttatctctaccattggtaagaaaaaaacagatgctatattttagggagtggaaaggaactaactgtaaggtaacttgggaatgagctatgaatactttgtctaactggtagaatctaataggacactcctgtcaaccttggcagctaaaaattaccaacaaggtgactgatctacaacatcaaaataaaatccccaaacacttcgatatggtgtttctccttgactctgctttttaatgagaaaaaagaaaacctatccagtcaatgaaaacaacaatgtaaatatatcaacttttgcaaacagaccagcccaaggaattctcgtctgagcacataagcctgttgaaaatgcaagtaatagggtatctataaactccaaacaccagataaagaacagaattggggaaaatggcctcaaactgttcaggctactctacaaatcacttattaagcagtattaaatctagtttcctaaaaccaatcctatgcaaaagagtcacaaaccacagccccaaattttccaaaatcattttccactaactacctatctttggacagccaagactgtggtggaatctaaaaatcaacgcatcactgaaaggattatccttcatattgcatacatctctcacctccacaaagaactgcttctcaaaactgacaattctgaattgacgggatgctagttttagggaagctttaacatagaaaaggcaaagaacttgaggcaaagaaaaaaagcaaagtaaagggaaagagggttacaaggaaagagaaaaaactgtcttttaaaacacatattgcctaagaaaaataaaagggcacattagcagataaacatataggaagaaatctctactgccaggagatgtttacaaaagaaggcagtgttggacatattgagactggtcagactgaacaagaatcagtgctgtcatgataaaaaaacatgaggcaaaatccagaatagcttttgaaatatccaacaacctgtaacccctctgtgacttcatttccttgtcaaagaagtgggaatttattctacaagctgcaagctgtttctctacgtaagctaagttttctcagggaatacttaaagggatgaaggaaaataaacctttggaaatctgtatttaaaaatcttaaataattcaagatatgggttttattataattagcaaatctatttgaatttgaaaagggaagtttcagatttcctaattaaacataactgttctggtttgtagaatattagctgtgggtcactcttttcacagcaaaaattcttctggggttaacccttgcccagcagttatggaaacaatgagctacaagattaaagtggccaaagacacttaaatcactactgaaaagtttggatgggtgtagaaactacaagagacccgaatgggagattcggactaaagctcattgggatagcatttgaaatacaaagtgttcattgactgaaatcagcaagatttagaaaggacaacaaacactcctcacttaattgcacatttatttccatgttcaggtggcaagaatgagctcctaagccaacattcaagtgaacagctgcagtaggctgtgtgcgctgaaaattacagcatctctctgctataggaccatctgctcagaataaaatgatactaatgtgctatattttacaaataatgcatattccattgataggctcaacacaactgttcacagaatgcaaactctttcaacagttactgggcaaataattttcagccagatttacaatttcaactttttttttggagcataaagaattgtaaataacttcaaaatttagtaaccaaaaaaatacatagtaaacagaatgtatagaattacggtaacttagtattcagaccataccaaaactttttttgtttttttaaaaaagcttgtcactcttttgagtctgcgctaaatcctaatttagattgtaaaaaaattacatacgagagcatggttctgatgctacatacaccactacagttaaaattgcaatgtgctttaagtcctaatgatggccataccacaataggttaaatgtaagaataattagtatgccaaatgaaagattcaagtgtttggtatggcctcagcactcctccaacatgctaaaaaaaagtagcctacagaatttaagaaaaatcccacagaccccggtccaaggctctgctgcccacgaaccacttctaagcagagaagccacatcacacagtctgactgccatgttagtttggagttgccgtctgcaatatggacacaaaaagtaccgtatgttagatgagcaagataatgcaacaaatcagtttgtacaaaatttacagtgattgtattgatattcccagcacgtccatgcagtgtggcttaattgaaattgaggcaattccaatctaatctttccaaattcatttcaacatgtagttttcttgcacaaatataagcatttttaattaagagcctgattttaaaacagtattaactagttatcttggcatctattctgaagaactaatgtaaaccacacctcaaaaatttaaaaaataaagtaaaataaagcaaaatactgcaggctgtcttatctcttaaggatgtgggagaagggaggaaatgtgaatgaaattttatagtgggaaaaagtcatcatgcaattcctaagtgattggtttgcataaaagcactctttccccaaaatatcagaaagacattaagagaagctatatttgcccacactgttacattatactataaatgatccttaatcctgggacttaaaattaaaagtgaatcgaaaccctgtgaggttattttgccactacagtcaaacggtttctaacagtttcaatgagaattgctcacatatactaagaggcagtaaaccagcatctttcaattgaaataattggaccgataaataggattgtttggagtaatgctcgcataggatgtcagctttgtccctgaacgaaatcaagtgaacattttttaatatgtaaattgtaaacccagcacgatttgaaattagtgctgctatgaggcctccaatatagttaatgggccatttaccacttattgaaacttgcccaaataccaaacagagccatgatattggcacaaaagccaaagtttactttttttgccatatatgcagatgcttcaaatggtcaatataatcagaaaacttagtttctaaaaatagacagtgaataacagaagaggtccaaaaatgtcttttacttattgataattataaaaattttatcctgagaggcaatcctggctgtgatttactcttgatattagcaatgccgccagtaacgatggattccactttctggcatctatcaaaaaggattaacatacttttttacaggaagccatgaaaatattttactcttcttccgttctcccactgtaacaagagattttggtctgaccctatgttatttttcaaaaaactacttatagtttaactgaacctgtgaaaaagtgctttacacccatgaaagatttttcataagaacccaactgtagttaagactacatgagcaggaccacacccagcagggtaaagcaggcataaatgtatgtcctgaataccttcaggagttcaatctaaacattgctcactacataaaacagattttaatttaactgcctcagtcccttctatttcataggaggtggacactaatgagctaatctattgacacccctctttctgaaagccccagggaggtgaacaatcactttattgcaccaactagataggaaggctgtgtatggaaaatgattctactgcacttttacatttcaagcaccccagacagtcttctccgcttgaggcagacacatacctttatgggaagttataaataagttgctcacatggcccttacctttatgctggccaacaattcagttactaaaaatgtaaagctacttccccttcacttaaggacaggcaattctgctctactcaatctaccacagacaactgggctgtgtactatttatagattccactggctctgaaactcttcggaaagaaaaaaaaggccatattccagtgaaacagagccattaattttaaggcttaaaaaaataatgtttcaatatatattctcctcttaatttagacatcacttgtgccaattcagactgcttttcctcctgttattatccaagtaataatttacgaaaaggcactttagcatagatgaatctagaatattctaaactttcactgggctccaaggtaaaatggctgttactatggtgaaagcgtaggttttattgggaaatagaagattgtctctacttttatacacacaggtacttccaaaaagccataaagacttctaaactttttatttaaataatcctttatgaattttaacatctactgttttcacaatagtggaatttagaaaataaatgctttatatctcatatctgggaagagttaagaatttgagaagtcaaactgatccaatagtttcctggtcacatgagagaaaagcagtctatattttctaatcttacaattaaaaaattctgcaaactaaggtaatcagcttcttcactattttcaaacctcttgcagacagccactaaaccaggtagttaatcaaaagcatcttaaataggccagactcggcggctcacgtctgtaatcccagcactttgggaggctgaggtaggtggaccacttgaggtcagaagttcaagaccagcctgggcaacatggtgaaaccccacctctactaaaaatacaaaatattagctgggcgtggtctgtagtcccagctactcaggacgctgaggcaggagaatggcttgaacccaggagggggaggttgcagtcagcagagatcacaccacttcactccatcctgggtgacagtgagagactctgtctccaaaataagtaaataaatatatcctaactatattctgagagttgttattaagttcactcagtataatgttgcgaggagggaaaaaggttccatagcctagaaaccacctgatttagggaccagacttctgcgggttaaagtcatagcagggctgctgaaagggccaatacaatgacccctggtgaggctgcgcctgttgctccagccactccattgccatggtcaacatcctgacctgggctctcatcttcttcaggaccagcaaattaaagcctccaaaaggtccctctctcctcatcctaatctaccttaacaatgttcccaggtagactttctaaaccctcccacagctccctgctgcctatcaaatgaagtgtaaactactaggtatcaacagaaatcctgtacaactacttttatcagcccacttattcaagcaccttaagatctgaactactccttgtccctcaaacagtccagtaccttcactcttctagctttgtttatgcagtcccatctcccttattcaaggctccatccaaacccaccccatctccatttcaggggtttgtacaaactaagcattgaaaaagcaaagggcaagaacagtttcttaaaaattggagactgaaagagcaaatccctccctaaatgtgtacaaactaggtaacttttttttttttttttactttttacaaatacatttaaactataaattggaaacacaaataatcatgagtggctctaacttgtttttctatcccaccaagtatttcaaaccagaagtaattatgaaagcatattttcaagttttgacgcactccatcagccaccctcacccactgaaatctaaattcctattatatggtaaaaggaaaccatctacctttgtgaaaagttgtgtatttttatttcaacaatctatcacactaactacaaaaccctggaagacaagacaaatccaagcctctggccagcagggttatggatatgggcatgtggaatttgggtccaacttcaggaaaatggcaaaatcaaaggtaaatgcaggaaaattaaacagatcttgaagaaggcatttagaagcacatcatgattaagtcgtggatcaccagtgatcttcatactaactagaaaagtttaggcaaacagaaacgataacatctcttaaaagaatcatggctagaggcaaagacaagcttatctctcaggctggaaaggtccagcctaaacagagtgaacttggtctctacacttatttgcaactagaagctttgaataccctgagtattcaaacacagcacaccaggacagaatcagcccagtacaaaggccttccttctgaccacatcaaacctctccctaaatgccaagttacagatgaacagaagacatttgtctctaaagttttagagccaaacatacaaaacacaaacaaacaaacaaaaaacaaaaccaggcatcacaacctttaccacaccatcctttggggaacttgcagcagggacaaaagcactccaaaattggtgaaataagtcatatgagcttatagatgacagctgggtaggcagtcaaagggatcatctgcccgacacacaccattcctatagcaaatgctttatctttcccattcaaatcactaagtggtattttcaggatatgtttgtggtttcacttaattaagcaagagaatagtcaaccaagtgctaaaatcacaaggctaacaatgtcagttacaggaacaagccattagtttgttttctttaactctctttgctttgtgattcctaaaataaaggtttgtagctttaaatgtcaaaggatttattcaatctagaatccttgtcaattctccagcccacccacataccatgttagctgtctcactagctctacgaattcctcaaacccacattttcagccttggggctaacaacggcccaagaacttgcagagacaatgcactgaacagctgcacgcgtcataaggagaatgttctttggcagcaaacactaacgtttttctgtctcttggccctttatgacttctacggacaaagtacacagtctccttcatgccagtctttctgaggttttgtagtttcagagctggcaggttcaaaagctttgaggttagagaggtaagataatgagtttagggtcccaagtccttctcttcagtctaagtccattacaggtatccagtttgagcaatgggaaagtaaagatctggcgaaaaagatctgcttaagtttcatgttttgttcattcatccattcaacgaacatctccatgcagctcccacgaattcaggagagtcctgaggtacagcaatgaagaagcatcttggagtgctgatttgctgtggatggtgtgtgcagaacatatacaagtatgaacacatagaagaaaacagtacatcagcaataagtaagagtgctgtggaatacatatagagaagaataaggggggttgaaaatgtggagatgaagacgggtagtttccagcattaaacaagcaggcctcaatgaaaaggtgagctttgaaccaaggtttgaaggagatatgggctggctgctgtgataggaagaaaaatccccttcccctcaatgtctacatcctactcccagaagtgtgaatatgttatgttacatgacaagggggaattaagattgtagaattaaagctgctaatcagctcaccttgagaaagggagattatccttggttactgaggtgggcctaaggtaattacaaggttccttataagtgaaagaggaaggtgagactgtcagggtgatgaagcatgagaagaaatcgaaaggacattgctggctttaaatggggccaccagccaaggaatataagcagcctctaggagctgcaaaaggcaaggaaacaatctctcataaagactctgggaggaatgcagccctgccaacactttaatcttagcccactgagaaccactttggacttctgatgttcttcggaattttaagacaataaatcttgtattgttttaagccagtaaatttaaagtaatttgttagaggtctaacaggaagtaaagacagcccccatggagatatctagaagaaaagattctaggcagagacctgccagtgcaaagcttgtctgctgtgcagaatgacaaggagataacagggagagtaggaggagatgagtctaagaggtaatgaggccggaacacatagggccttgaaggccaccataacaaaaaaggaaactataaaaggttttcagcaaaagagtagcatgtggctactgtgaaaataaattgtgtgtgggtgtgcaggaagactcagtgagtttggaaacagaccagtcaagaagcaactgcagcaattcaggtgcaggatgacagtgactcccaccagggtgaagttggggagaagtcatcagattctggatatacccagaagaaaacacattattaaggtgctacattttaattacatcagtacactgttgaaatccattgtcaaaaaactggtttagatactaactgctcacattcctacaaaccaccaaaacatttactatgctctggacactaagaacacaagatgaataagcaaaggaagagattttatggacagttgtgccttaaaagaaaataaggatatatatataaatctatatatagatatatataggaaacccaacatacaaaaattttgactttataaatattaaatccagagttattcactttatggttggatattcactattcactttatatttgctactaaatgaatccactgccagcttcttaaagaatcaactgattcatttaggagcaaatataaaatcacaaatcagtagcttaaaacatgcaactactactaaacatagtatatcagaaaattgatttgtaatctatgtgagcccccttaaaactttcagaattcaaagtaaaatagctcaaagctctccccaaaagtttaaaaacaaagtggatgaagattagattaagtcacattttgtaaaatgggagtaaactttaaaatctgtatttttcaacagggtcatttatatacctctacaatagtaaaggttaagccatgagataactctgtcttggttataggctggaatacactaaatcattaccttctggtgatgaatcattccaaccccattctttcattccaacctaagtggacccaattaatttccatgccattatttggcaatagaatctaaaaagggatatgagtacaacaagaataaaatcaactactccctcagttttgtggcagaggttttgtttggtataggcagattaatctgaattgctaaattaagacagttaacatagtaatcaacacagaaattggattaacttcacattcttctacaaaagtcacagctatcaggaaccccctcagggtagtacaaattgtgaaaggctgattggaaatcctcaaattaatcccagtagttgagtgttttcattaggtaggttaaaaacatagctcctctgttggatacagacactaaaatactctgtcatgtacaaactccaaagcagaaagaatgactaatcttaaagggaaaataaaagacaaggaaggtttatggacaaaaataatgttttttaactcacaaatgttataaaggccacaacactcctcctggccagtgaggttaacattttatttttcactgttatttagcaggacttagagatagaaaaccaaatgctacactgtttaacctcaagcagcttacaccaaaaaaaaaaaaaaaaaaaaaaaggcatctaaaatgtcaaccaacaagatttatttccttagtaacattaggaggctacaaataaagggatgccatcccagggcacataaatatcttagaattcattgatgtattgtggagagcaaaacaaggagtctaaaaaccttgatcaatacagacagcttccttctgctctgaactgtggatcatctcaattactggtattcacctatgaaatgtgtttttcttttctgttgatgtgtaacgtcctgagattcccaagacatgtatacttgtgatttagagacacaactatgttttatttactatggaaatttgaggcatcttaaaaaaacaagattcacaccctaagatagtaactttatttcctttggtccacctctgcctcttgctcccccaaagacagctttctttaaaaaccgacatcccagctagaacaaaacacacctaggtacatctgtgactttttatggtaattaagttcctggttatttactacatttcaagaaaaaaaagtgggggagggggagaatttacattcaatgcaagtgttatttttattcagtgattccaaagtgaggaaagggttgctaagggcgagaagtatctcaaggaaatgtcttgttaatctgctacataagaatgtatataagagttaataatgtttttcaaaaaagttaatgctagacactatagaacaggtaaggcccttcttagcctcagaccttatccacttatatccacatcaggcacatacacccaatttcgaacaaccccctaacagagaaaggggtcaatatgcttagattgatgacctcaccatctcacccagcatagagcttcctcttactcctacttttgtcagacttcccgctttgcaagttgtcttagtatcattcaagtaaagcacatttgaaacgaacgcttaaggatctcaaaaagtaggtggggcaagtacccccatgttacagatgaaaaatgaagcaagtgtatgagcatatatgtatatgtataacctgtatatacattatacacacatattcccaagtgttgatgagaaacatctatcccccacaggctgaagaggagaagggagcacatacgcaattacaggctacattttaacaggaaattattcttaagactcaaatcacaaaagcattagcctttgaattatttccactctaggaaggaaaagagcaggtaaaggggtctgttctctttaaaagctttaattacatatacatattttgtctgataatgtcaaagcactttacaaactctaaggtgccaagtgaacagagggtattatcattattgctggacaaaacaagatgtctcttaaaatgttagcatagaaaatttgcttatctgggcctggcgcagtggctcacacttctaatccctgcactttgggaggccgaggcgggcagatcacgaggtcaggatatcgagaccaccctggctaacacggtgaaaccccatctctattaaaaatacaaaaaattagccggacttggtggcgggcgcctgtagtcccagctacacgggaggctgaggcaggacaatggcatgaacccaggaggcagagcttgcagtgagtctagatcgcaccactgcaccccaagcctgggcaaaagtgcgagagactccatctcaaaaaaaaaaaaaaaaaaaaaaaaagaaagaaagaaagaaagaaaatttgcttatctgtcttttggattaagcctgtcagtttttcttccccccacatctaaatggacagcaaggctgcagagtcgtgttgggagccttttaacatggaaaggaaagactgtggacagaaagtacagtatgcagacttttcctaatcatgactgttaattcctgtcctggactgctgaagcagatgctatgttaaactacatttagcacagtcacaaacggtgactaaggaagttaaaaatttttacttgcaatgctgcaatttttaaccccagacctccaaagactatgtttaaatatacagagtactaacagcccaagtacttcacattagaattacagccttgcctattttaatttaccttatttttaaaagtgtgtgacccccacccccctccccaactccccataaaaatacacatctcccatcctctttgagcctgcttatgctcaggctcttggaattttaataagattagaaattgctacctccttattctggctaagaactccaaagatgatccaggcatcttgtacttatattcagatttacaatacagagaaaacaagagtgtagaaatctaatccacgattataccctagaatctagattaataatgtgtacattatgagatcacatgggatcaagtttccacaattaatggatcaggcaaatgatccatgtatctacattcatacaaaatcatacactctcctatcatctttctcctatcatgatcttcaaaaatgacctgaatttaaactgtggctttaaaatcacatttaattacaagaaaaatagaaaaggaactttccgtgggatttgagtatcttttgctacagtaaagaagttcagatgatctccctgccttctggagaatccaacgaatcctacaactaaaagtaaaaataaatggcaagggaaagaaactagcaattattgattcctctttccatgccagtctcaagctagatatttacaaacaaaatcttatttaatcctcttgtggagcgggcaaggtgactcacgcttgtaattccaacactttggaaggctggaggacaccactgcactccagcttgggtggcagagcaagaccatgtctccaaaacaaatcttatgcactataagctatattacattctcttcaatttacaaatgagaatttcaaaacttcaagagttcacacaagtattaagtgagaaactgggatttgaaatcagtgctgagaccccatctagagcttcctagctgatctctctatttccaggcttgcccctttctccaatccttcctccattccacggctgtggggatctaactaaaataatgggcagcactccactactatctcttttaaagctctgctcactccacgttgcctatgaagtaacatctcagctccctagtgaggcagctgacttgaccgagctcctacctcttcatccacatgcccagcacccccgcatcatatacacaagctctaacaagctcccagtagttcttcccactcccagtgttttccagtgtcacccaacctgttttctccacctgcaacagcctacctttcttctcctgcctcatggaaacatcctcagcaccggaagagagcagacaaacctcgaggaagccttctgtgaaccactcagttggaccagataactctgtgtgctcctatatgcctgactcacctttatctccccagtaaaaaatatcaagacagatccataaagagaatgaatgccatgaattgtgattcaaggtggcaagtaaaaaacaacccccttacttatccatgtggttttatgttccctgccaagtgggaaaaatttccattgcaaccctgtatagctggaggagcagccaaagtcatctcaggttgtttataaagaggaaggtagactgtcaaggggaaaaaggggaaagtaggctgtcaagtcctaccactaacacacacatctctttccgcatatagctactaattccatattgtaagctcaaacttcaagtggaatcagcattttttaattcctagctacaagcctttgttaaaacaatataaacctcagggaggaaccagggacaggtgtgttccattgtcaccatctcacagttcaaaataagccaatctcatcaccaatgtgtaaaatcaagaggaaacctgaagtttatactctctccccaacacagccaaggtctggtgtgtagaataccaaaaagaggagtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaacatgtaaattgcttagcagtaaatagtctttaactgttgataaaactttcaggaagtacctactaagtaccaggcaatatagtctacagcagttaggactgcaatctctttcagatcgagctaaaaagaaattctcgctatcatccactactttaatctgagatgggtatgaacaaaaagatccttaaaccactcttctaaagggaaccatgaccctgaacccaaatttttcaattcttctgtgaagagtgtagatctactcaaatgccactctatcgctctatcttagactattttaaagagttccttgacgattctgagtgccagtctctagttgagaatcactataagggaaatagatggtttagaaacgtgccctttctatacccttctgccccacccaagcatgctttttacatccatcctttgtcaggctaaaacccaggattcacaacaaagatctggagactgcaggccttggaattgagttgagtcatcaggacactattctttattctccatttctaaagagcaaaagtgggaaacggggggtatcatgaggtagaagcaagaacggtaaattaaaactgaagaaaacttccactgcactggaacagtaattagaccaaatttgcctgccatcaattaaggaagaacaactgctctgcatcgctggctaccaagacagcagttagttctcttaagtaacttcttgctctaactggaaaatgacccatacttttacttgccaagaataaagacagctggcctcctacattacaaataaccaaaatggaaacaagtgaatcttttttatccaccaaggttgactacacattaactaagacctattctaataaacatggccaacataaacagcagcagccaggtggcctactctgaacattcttcctgatacaaagtacatcatatacctaagggcatggtgaacaaaaccccccagagtggctatgaccagcaggaagaaaacattgaggggatgggagtcaaaagtctacttaaagtattaagcattcaaataaatggcagaatccgagggccagcttgcaaaaacaaaaaataaaaagccaacaatggactctgcttaaataaatcacgtgcgaggttgaaaagaaggacaaaggaaaagtggcaagggatagacaaaaacaagcagattctgtaactctcctcaacctccaggccaaagttcggactggcagctagcgggtagatttagcctgaaaacatgttacgtggtttctccaacgtccttaaaaacaaaacaaaacacaaacaaaaacagtagtgttcaacatttaaaatttcaccaatgtaacaatttcacattcataaaactatatttctgatttcgcttaataaataaagtttggcaagagtccatattcccagagctactagccagcaggttgccctataaatggggtgccttctttccagctctcccaatacagccttaatgttccggcccctgcaagggctggattttaagtaaaagagtatcatagcctaaatgtcaaatgtgctaaagagtatatgcttttctaccatgatggagaggttcagaatgtcagagtactgggggagggagggggttttccaaggtcatctaaactgaggatctttaattgtagacctaatcatctgtgaaaatattctaatgaatatgcataacaaaaaatgaggcaaaaaagcatcaagtctgtgtcactaaacatcctaatatgactgccacagacattcaaagcactctaaataactcattttggcctgtttatactactatggatttggattagaaagtcatcctgtccacaaagaattaggtatatcctgtcccttctgggggctgagtttgagacagttaattcaaacctaatcaaatattttgctatgagaaagaagaggaggggccaatgaagtgctttatccccaggatgaggcagtgagtagggcagcacacaaaaaagataaaaatcacctggcactacaccagaagcccttgaattaacattaaatttccaggttaacgctctaaaaactgtctcatgacaaaccacaaattgtattttggaggtaaaacaggaggtaagtggggaaggaactgaagggtaaataagaggtcttacttcacactttttctgctgcttttggtttaccccagtagaatcccatgaaaacctgcttcacactggcaaagtgggcagacagaggaacaaaggcaattccagggcctgcagaaagtcttcaaaggcaagggaagaaagcaacgccctgcctaaacactggctatttatagcacagcaatggaagatctgggaggtggctgagggaatatgaaagctagagagtgggtgggcgggcttccttctggcttccttagactcagaaactaatgcattcttccctgcctccaaagctgctattttgtttcctgtgtaaggtttcaaaatactgcaacactgtccctaggtgcatttgacaatatcagagcaattacagtttggttaaaatctgaaggtaatcaactcaccattctttgctattctctagaaaaagaggcctgaacaaagaggaggagacaccaccatccaattcataaggatggtctcccaaaatcccctgaactttcacagcgcggaaagtttctgtgatttcaagcagagaccaggagaaactatacttttcacctcttctcattaactaaaagccacagctaaaaataaaaagctggagcaattccaaaactgtgggttttatagggcacattaaattattccttatcaactgcaaacctttaaggttgcagagtattatgttaatgctattggctttttcttttttttccccagaatcggtgatagtgttccttaaaaaaaaaaaaaaaaaaaaaaaaaaaaaaaaaaaaaaaaaaaaaaaaaaaaaaacttcatgaacttccaagtccaatctctattgcaaagtaaagtatgggttcctaaatctgcagagaatatcatctattctacaaaacctcacacataacttaggttgattctcttttccaggactgtattataaaacattttgaactgagaacagatcaacagttggtattaatagtaaattataataatcattttacacttgtttcctaatctcatgcatgagattcaaaaataagaaagcagtctaacaacagagaattttctaaacagaatgtgaagctctcacatttattcaaatataaacactaaaaagtgtttagggttccccctggacattcaattgttattaactcttaagataaatttccaacttaataaacttggaaaatggctttttaagcatattttcaatttgttgaaagtttataatattgaatcctatgagtctttttataattattttcttagaaaatttgtggtcaatttcctgtgaccttcgtaaaacttaaacacacctcttagctcacatccataactatgttggcttataccaacattcttcttatattcttcattaatggtcaaggttaaagaaataagagtatttggtctaaactcaaatcaaatgatcatgtgtaacacacagcagcacccaaaacataagcactattttccataactaaaacatcagaacctaaggcatccatttataccaaaatgaagattttagttcagctcttcaggagagttaagacatggccaggtaaattaaggccaaaaaagggcaagtcacaacactatgtagcattcaggaaatttggagcaaatttaagctttcacataaaacagtcagggttaggagtggcctcagagaagcaattatctcattcccaagtcccaggctaacaaactaacagggatatggaaaaaaagactagaacgaaggtaaaagcctacataaagtccaaagacaatcactgctggtcctaaatctatttcttaatgattctgtgaccctcaacaagtttgttatgttcataacttccctcatctattaagaacagatttttctcactctgctagcgaacagggttattaaaagaaataagttataacaaattacagataaaagaatggcttataaaaaatttcaggcactatacaaagtagggtattgttctcaaggcactaaccttcttgagaattgttttctgctttcatgctctcctaaaaacacatctttaatttatggtaaggtcaaactgccattatcactgcaacctgagaaattcaaattaatggtcaaagatacacataaacacacacactccaggctttgctttcttctttccctcaaaaggtcatgttttcaccaaacagatcaggaattctacaatatactacgttccaagtaccaaatatttaagccaccaaaacatacagcagaatagcatatttaagaaaagtttcttttttttctttccttttttttttttttttgaagataggttctaattctgtcaccaaccaggctggagtacagtggtgtgatcacagctcactgcagcctcctgggctcaagggatcctcctacctcagcctcttgagtagctgggaccacaggtacacaccaccacaccccgctaattttttaaatctttttttgtttgttttttgagatggagtcttgctctgcaacccaggctggagtgcagtggcgggattctctgctcaccgcaaactctgcctcccgggttcacaccattctcctgcctcagcctcctgagtagccggcaaccgccaccacgcccggctaattttttgtatttttagtagagacggggtttcagcgtgttagtcaggatggtctcgatctcctgacctcgtgagccgcccgcctcggcctcccaaagtgctgggattacaggcgtgagccaccgcgcctggctaattttttaaaatcttttgtggagacgaggttttgccatgttgctcaggctggtctcaaactcctaggttcaaaggatcctcccacctcagcctctcaaagtgctagaattacaggcgtgagccaccatgcccgaccaagaagtttctttaacataaaaatgtccaagcagataaccaagtcaaaacacttttattactgaacagcagacggtgatgttttagttggcaatttaagaatcacacgctatagctattcctgaaaaattcaaaatcaaagtacatcgtaagcatttgctcagaggctagcatagtgcttaacgcagagtcttagcattctcaaaaacatgcaagaccagcctggccaacatggtgaaaccccagctctactaaaaatacaaaaattaaaaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcgtacgttccatcccataccaagaaaaccactttatatgctcaaatacttcttggtatattctgccaatgaggcgattctacctgaatttattaataaactatttaccagcctgcttgaccaccaaggtttggtaaacagacttgggcccgatgtggaagcatagctaaggatggagaccccggggcacaagaagtgagctgaagtgaaaccaggaaggaagacaaatttctttgatagcctcttctctttccaatcccagcttcccatctcagttgctcattgtgccttcatcccctctcccatttgagagctcagctgagtctgcagatatcccaagatactaactggtaactatttggctagagtgagagcccacttcattttctatgcatccaacaaactcttatctcaaaagggcaataagcatacctggaatttactccaatacctgtgaaaggtagccaaactctactctccggaggcgtgaagtcatcatacttccagataagacattaataagcagaattatccttacctcatttgttacactttagtcctccaaattaaaaacagccaaagagaaactagcttgtaaacaaaagtaaatattcaaggtgccaagactggaagacagcaagatctcactcagctcacagtctgaagccacttaaatggagtaactccaaggaaaaccgaaagttaaactgaagaaaaacatgtaacttcagagagcatgaaaaactggtacaattctgcacaactacaaagtggccatgcactaacctgaaaacaacgaggttcattattgaataaaggcatcaggaattcttggagatggagctttcaaataaggctttagtcaccactaaaaggacacagaagaaaacagatatgcctcaaatatcaacacatttgaaggacagacatctgcattcattctaacatgcaaatcctatgtgcagggcactgtgctggataaccaagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgtggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctgggaggcagagcttgctgtgagccgagattgcgccacgacactccagcctggggccacagagcaagactccgtctcaaaaaacaaaaacaaaaatgctgggcacagagactatagcataaacaagacaggtactaagggaacttagtgggagagacatattaaacaagccaaagaataaagctaatgtttagaattgcagttcatgccatgaaggaaaaaaggatgctgtgggaataaaactgggacagtgatcagaagaaaagccttctgcagattaagtgacatttaagctgagatctaaagataaacatgactacatatatgtaatacttggtctttggaaggtaaaggatggtgccacacacatactaggtagtgttgggggcagtgggactggtgaataagacataatttgtaccctgaggaatgtcatcctagggatgcaattacatccaatatgtggaacccagcaggcagagttttacaattatggataaaacttaagctacagagatcttgaaacccatctatcctcaaccattcctttttatcaaatgaaggaaatgaaacccagaggctggctcagtgtttctgaactaggtaggtgcagaggtggggcacaacctgtaactcccattacatcacactgccaattaactttttaatcagaatttatgtggaatgtcagaattcagtaaattgatcatgtacaagaaacacttaatatccgtagggaaaaataagtagacttgggcctaaatgccaagtacttcactagacattgtgggaaaaatcttatttggttccaggcaaaataagaaatgtaatgagttttttgtaaagtgaaatatattcaatttctcttgtgaagttacgtgcatcctactttggggcatctaagcaaaccaggaaatgacagtgataatagataatgtgtcagatggtcttaaatgcctttccttggcaaaacagagttgacaaacctattattcccctcccacaatgtacagttttacttcttattgtacttccctgagaagtacatatatcaaggaacaactgtcacaatgagggttgaggcagtagagggagccactcccagagttcacagcagcactgttcatcaaagcacaagaaatgaaaacaaagtgtttatcaaggaagatgaacaagaaagatatgaagataaagtcatacaagttcacacaattcaatgttcttcagcagccaagtaagagcccacacatagaccaaagcatattataaaatgagaattttgatgaatttaacttagtgtcctggaggacaaaaaaggacttaggatcttttagttatcacagctgcacctacaagtcaaatataggcaaaatgaaacatttttaatcagatatctcccaaattttgcattactttaaggatagtgtgaaaacaaaaataacaagggaggaaacaatccccttcaaattgaagccactatagctcaatcctcactgtctcacgtctgttaacccaaaactcccagtatgagtacgaatcagtcacgacatagaaatctagacctattctgtcaatgagcagctgctccaggtctgcatcaatctgtaaacaggtatttccaaagcatatgaccagctccagtctgagcagaataacagatcaaaactggagaggacacacaatgggaaaagtagttgatcggtttgatagaggaagagacactgggtcccactcaaaaataaagtatctcaactttttcactgaatttacattcccaaagaatagattgtaaaataagtaagaatcccagacttttcggtacttgaaggtcactatgaggtcacctggcatagtgatctactgcaagaacagcctgactggtcttcactgatgctacattctattttgtactctgtctcaagctagctgaacttgagagacttctaagtctatccaaggacatttgaaacatttgtgataaatgcagagtatttatctctgttaacaatgaagaaaagtcaccttccagaagaattgctgtgaaagcccacatcgtgtgcactattttttaaaaagtaacatagaaaagctgtttaacataccaggaaagtcaaggagaactttaaaaaaattataaccataatacctaatttcatcaaaatgatgtaagcaacaaagatctaatttatattgagataaactatataggctcagactattcaggcaaggaaccagtaaatgcttatttcatactgaaatttacaggacatgaatgacttagcaatatatattgaccctgagctactgaaatgacaacaacccaaaggtgattactgacatatcagaagaataacaatgaaacttgagggcgagagtctctttcacactttaaaaaaaaaatgcagctcaataaaaatgtacctattaaaaatagaaagacagttatccctttcaactggtgttgatctgccctttattactggagatagactgtatcactcagaaagttaccctgaagctataagaagcttggaggaaaatattaaacttcaaggtacagataggaccaggagcctgttaagacagaaaacgaagacattaatgttcaaaaagtatataagcaggaaacctgcagtagtctcagtaacagattttagtggcaaaaaaaaaaaaaaaaaaaaaagagagagagagaaaggaaagccttttaaaaatctaagccactggaattttaaagtgacacccacatgacccagtttacttttctattcaaagaagttctgatgctgtttctctatttctctttggaagtttttcatgtccaatatattgcaaaagataaaaggtacacttttatttaagcacacaatggaataaaacatcactgaggaacttggacctgtaaataaattttaatgggaaagacaagaattcaaacatgaggaaagggcaacagatatatatacggcaaatgtgagaaagaatatgagcatttggaaaaggaagacaacattgttggacagggtaggatgacagctattaatttaatttaggatatgctaggccatgctctaagccgttttaaagggcattacccccctgtgatcctaataacttaataaaatgggtcatttcatccccattttttttttttttgagacggagtttcgctcttgtctcccaggctggagtgcaatggcatgatcttagctcactgcaaactgcctcagcctccagagtagctaggattacaggcacccgccaccatgcccagctaatttttctatttttaatagagatgggtttccaccatgttggccaggctggtctcgaactcctaacctcaggtgatccaaccgcctcagcctcctaaagtgctgggattacaggcatgagccaccacgcctggcctcatccctatttttcaaatgaggaaataggcttaaaaaaacaaaaaaaaaagattaacttttccagaactcacaaaacctgccaatgtgggtctaacaaactccagagcccatgctctttgcaccacacatcaatgaagcagctaaaataaccaatatcttgcttcaccccagaccaattaaataagaatctctcctaagggcccagatactggcatttttatcagcacccgatttgattctaatctgcaagcaaggatgagaaccactgtaaaagacttttgtaagacaagtggactatcagctaggtagtgccaaacaaacaagagtcaaataatcagagactggggaattcatccagcttttagagggcaaacagaagttcaaaaacagtggaggtgctgaggcagagctgatccagactaacttcagggaaagtctgaacacaggctttagtccaagcagtgattaaaaaggcgcaaaaaaccaggttggaatcattttgctgagagaatgaactacaggttagaaaatttttacttttaagactgtaggtaagaagggagcacaaaatgacttttacagctaatgtaaccaatgggtatgaattttaggaaaataaggaaaaaataacagttgactaacctaaagccaatggaccaggatataaaatataacaagtgagtgacaataaacagagcttgctgagcaatcggatatagcctagtagttacaactgttaactctacggtgatcccttctagcatttgccatcctaagtcttgatttcctcatttaggaaatggagaaaataatcctatcatctcattcagttattggaataaatatatgagatatggcagtcccctttttaccaggcactcaaaagccccaatagatgcctgaaacttcagatagaactgacccctaccatgttttttcctacacatacctatgataaaatttaatttctaaactgggcccagtaagacattaacaataactaagaactgctgtaacagtacactgtaataaaagttatgtatatgtgatctctcagcgtatttagttttctttaagtcgagaactttcacctttttacttaaagggaacatggagcactttaacatcctctctttggcatgtcagaactgccagcatcactactcttgtgctttggggccgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggaactactgccatccaagcaaaagaaaagagaccaacggcttctgtattcttatagagggcagtgtaagaatatagtcccccaattttttccttcttaccattacaactttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgtatgtcccctaaccctactgaagtgaccgtcatttcacaaatagtgaatttatatattaagtgatttattaaatttatgctacatacaaaattacgtattaaaatgcatatgtgtcctcaactgaattcttgaggcatagtattgaggaaacagttcaaaatagtaatacaattcggtaaaacttttaattatttctcaaaagaatccacacaacttaaaatctgacacctgctgaatgataaagcttggtcatctgcacaacttcctattcaactttcattttcacaaaccttattttgtcttaagatgatttccacgcactcagcagggtaatcttttagctaaatgatccgaaacccacaatctgaatggcaagaaattgcttcctaaataatgtatcgtattatacaagctatcacatatctcccttccccagaaaagtaaataaacattcttaaagacagcccagaggaaaacagtatggttgcaaaacagttagcttcttatatctttcaagactttactaaatgtcacttataaatgagaaaacatatttgaagtttttaagtgttctatgctttttaaaccctttcctgaatgtatacaggtaggacactcagaggtaaggtaaggggtaaccatgttcctaaattacattaatttctaatgcctgaaaccaaagttttcaaagggctataaatgcttgaataatccattaagatacacaaaatgacaggttgatggtaaaaaaggggaaaaaaaaaaaacaacctttcaacaaatgacaaattttctcctaaatcattctttggttagaggaccaatgtaaaagaggcaggtccgagtgctgttttgtactggaaacaaaacagatgtaacaggtgtaatgaataccagagagagatgagacagaaaatcttgaaattaaacttctgtggtagaaaaaaagagagggaatacaaaaatatatggaaatgcctggttggatgaaaggagagtagatattctaaccaaaccatttaaatccacattattagacaccccaatacccgctttcccagtctgtgactgcacaggtaaagccaaaatatattttctgctttggaatagattttctacttaggattagttacaggcatatcggctgctctgggaattcactttcaaatataatgaggccacactaaaaacttgaaggaagtgaaatagtatccttcatctcatctgtcaccataaagctcaacgtaaagaaagctaaaaggctcactgcagtccctcaagaaaaagttaaaggtttgactctctgctgattaccttgaatagacagccaaattaggctggagcaaataactataaactgactatctaatgtaactaggcattagccattcatcccagagctttaattttatgttttatatattacggttcccctggtgattttccgcatacctcattaagttctgacttgaggatgtctgctctggacgagcacacagagcaacacaacacaaaacatcctaaacctcacatctcttagtatttccaacacaaacatcgcaggtctcctgatgaacacttaacctctacatgttctctaagtacagagtgcctagagtctcagagctgcacagacaccagcagacattctgtgaaaacactgccaagaccctcttgacatctgtggcaaaaacatcctgtcttctaaatatatgttctgtttaagtggcttttaaagcataagcatggtgcctttaaaagcagtttgtaacaagaggtcaaactataaaactgaagaggttagagaagaaatcaattgtatatcaattgtcaaaactcaactttaaaaggcagaggtggtcacaaactactgtacagacagggtaaatggaaaagaaatctccaggttgaaaacggcaaatgctaatcgcaggggtgggagcaaggagtcttgaccaatcgtaaagatgagaaagcatttcccttctggaatgaaaaactaaaactgtagatcagaaattcaggggaaaagaatcatttctgttcatgcctcgagaaattaaatacccttacccctgttagagaactgaagtgtatctcccaaaattaacatgttgaaaccataatctccaacgtgactatatttgaaaacagggttgtgtagttcagtagtttcagtagaaacggtacttcaagtaactacacaaccactctgtttttcactctatttccttaattatttcaggaaataaggctaaatgaggtcataagtgtaaataattaagaataaatgaggtcacaagtatggggccctaatccaataggattggtgtccatataagaaaaggaagagacaccaatgatttctccttctttacatacccagagtaaaagctaagtgaggacacagtgagaaggtggccttctgcaagcctgaaacagtggtcttgccagaaaccaacactaccaaaaccttgatcttggtcttccagcctccagaaccatgagaaaataaatttctattgtttttgctacccaggctatggtattctgttatggcagcctaagcaaactaatacaacccccacaccaattcttaatctctcagttgtcttttcctctcattgctgccacccaatcttttcctggaatctgaaccttaggtatgcaaatagtccccaacttacatggtttgacttaacagtttctaaactttgtaatggtgcaagatcgatacacattcagtagaaacagcacttcaagtaactacaccatcattctatttttcactgtcagtattcagtaaattacatgaaacattcaacacttttattataaaacaggctttgtgttagatggttttgcccaattataggctaatgcaagtgttctaagcagatttaaggcaggctaggcgaaagctatgatgttaagcaggttaagtatgttaaatgtattttctacttatgacatcttcaacttaacttaaagatgggtttatcaggacataagccccatcataagtcagagcaccttcttgtagccactgaaccatgccccctcgcttttgaatcaacactgtcatctatccataactgctaatttaccttcactaaaatgagtgtctaccaatatctacccctcatcctccaattcccatgagaccagggcaagcctttatcatcatatacactgcttcaaatctgtctcctcctccaacatgctcatctttatataatggctagcttcaacttcccaaaaacatctcatgctatcacttgctcaaataccatcaattgtatacatacagaccttcatttaagggcctttttaactttctaatccatccctaatgttttctcccaacttctcaagccaaaaccctgcataaggtcaaaatgacccataaccatcctctgaatctgttgcattattttatttacttccttttttcatatttttcttttattttttagacacaagttcttactctgtcgcccaggatggagtacagcggtgtggtcacagctcacggtggcctccaactcctagaatcatgctatcctcccccgtcggccttccaagtatctgggactacaggcatgcatcaccacacccagttattttttattttttactttttgtagacacagggtcctcactatgttgttgagactggtcttgaactcctggcctcaagcaatccctccccgcaaggcctcccaaagtgctgggattacaggagtgaggcaccactgcctggcctgtttccttgcttttattcctattgttgtgacaatttggaatgtcctctctgcttatttcctttctaaatggcagctggaagaaagaagttctgaagaacattacacaatcacaaggggcttgttatggcaaaaccttctaccctcaactgctgctctgccacatactgattttattcaaataggcttttacctccaccaaatcatgccaggtacttacacaatatctgaaagatggtaccaatttcagctccacataaatagaaaatgggaagatctgacacaaatgaaattcagagttttcagaggctctcatctccccctaagtattatcatcctaagtaaggtctagagaccatgagacacacatatagatttgatctgagctcaatcagttcttctctcaaaccctcaactttttttctaaagctatcacctaaatcccagcaacaaaactaatagagtctctcagattttcccaattttcaacgatcccctcccctatcattcctccaaagaacatcataacaagcctcttcaacactctctttatgagagcctgagcttcgtaacctatactggatccttattgattttcatcatgtgagtgacaaaacacagtaatatactaagatttccaacaacctgaatacctggctcttgatttttacatgcccccaaaatagcctctgtcccactcagtggactttccacctccaaacttttataactattttctccactcatgatcttctccctactggttccaatttacacgcatgctcttcattataagctttgctgatcttctctaataaattttgcttacccctttaaaaacagtcctccaagagctctttcctggtaacttagcatgcactatatcatacagccatttgtaaggccccatcaatgactccacctgtatgtggtcatctttatatagaaacccaaccagaatggagacataaaattctagaagagctttagttctttcatcattgtgatctaaatcaaagggcactgcagtcagcagcacccagagatactccaatgtcactgactagcataccaacagcattcaagctgcttcatgagcttatctttccccttctaacttcagggttggtagggcaaagaaatgacaccaatgacatctacaatcagggcctggaatcaaaagcaaactgatagtgtaacattcagggacttcagtgacactttcctagaacactgagtgcccaaaagggctgggccatcagcttcccctaaagaggggaaaagaaccacccactttctacaacagattgactgttaaacacacgtacagcaggcctcttgcaggagaaaaggcaagctgtcctgccagagttcctaaaagcttctgaggacaacaatttttcttagggagtgaaaatatataccctaatccatactggatagacagcccccatttttcaaattcaaggctgaataagatacattcagttttaaacattcctagaatttgagaattccaaagtatcaaccatttttacatcaaataactacattagtcaaaccagactaattattaaaattacacaaagcttgtacaaatcaatccttaatgtttaggaaaatcatgaaaaaatttgtgtggggaaaccagtctaatcttttcagatccagtacaccaaccacttggcaatgctccctacaatctgggaagatttcctgaccaatggaatacagataaaatatggcagagtatgcattaatccttccatcttctcttgttttaataataagtagagagccaggaccatacaaattaggtatatacagctcctagaaaaataaaatttaactaaagctaaagaagatgaacacttctttaaccaaatttcccaccttattttatcttatgcacacctacaaaacatctgtatacatgccttataatagcttttgatcaactgctatcaaaacaaactaaaggagtaaaataatattactgctcttcagacattaaaaaacacatttctaagcaatattttcaaagtcaacaactttgaaaaattaagtccttatctttatagaccacaggctcattataattaagtgggtagtttgtttatattttatataagattccctaagaacctaagatcctgccagtgtctatttaagaaatggagaaaatgttgggcgtggtggctcatgcctgtaatcccagcactttgggaggctgaggtgggtgggtcacctgaggtcaggagttcgagaacagcgtggccaacatggtaaaatcccatctctactaaaaatacaaaattagcttcgtgtggtggtacatggctgtagtcccagctactcgcgaggctgtgacaggagaatcgcttgaacctgggaggcggaggctgcagtgagccgagatcacgccactgctgtccagcctgagcgagacagagcaagactccatctcaaaaaaataaaaataaaaaataaatggggaaaacaacattgtaagtactggaaaatactacgtccatagtcattgatatataaaatgtctcaaaaaataggactgtcataaaatacagaacctcttacagagaagaaattttaagttgccactattaaaatggaatttaaaatctcaagattccacatatttaagaacgaatattcctttgttcatcacaaagctgagacaaaaacaagacatttaatggcaatgtgtctcctccctgaaagttgattttattgctatttagcatttccaggaaataatttctaagagctaaacaatcatttttaatattgactcctcttcacagcccgctctgcagcaccaccaccttcttacaaaccgggggaaaaatgcataagtggatgtttaaattactttcttgatcaatattgtttcccaccagattttggaatattatgaaaacgaagtgtacccattttggtccttggaccttcaattgtttcttaatttttatgagaaacaaaaatttgaacagtaatatacttctgcaatccaaagaagaattaaaccaaaagacaaatgatgaactttctaggtcctactataaaacactagagttagaagggtgatcattgttaacatacaactctggttcaagccctggttatggggctttcactgggttattacagttcttgttatttacaaatgtggaagcttattacatataaaagctcttacttctaataacctttgggtaacttgcaatctccatttaaaaagcctcttcctcacaattactgtccatttgaagagcgatttgacccatactctgtcctttgagacatcacataaaaggactctcacctactcaaaaatcaatcttttcagtcagatgaaatcttaatgaaagctgagatcatctcgaggaaagcaaaatactgccaaaaggcaaaaacagcttcacactctaacggtaaacccacaaaattgccagattaaaattctgctgcttagtcattatgatccaaagatgcatgacttgcctcactagggcaatggctgtctataagtaagatatctagagtttacaccatccttacggagagccttgacactattattgccaaatctatacgtagagttagttccctgcacaagaagatatttaattatagctctataattttttttcaaaacagagtaatatcccaaatatgtaaaagatatcctgagaacaattgcccttgcccttcgtcctttgtataggttattctactgattcaatatcagtcatggaatatactagagaaaatagattctgacttgcttatctcttcattttaaccccattttcctcattccaaatagtaaggatgcatttgagagatagctaactataaagaatgaggacagggacaatggactgcaaagctggttgatgcagagtccaactcacaagcatgacatggtagccaatttagctaaatggacacaggttgaattaacctgacctttatgcttcaatgtcctaatttgtacaatagctaccatctgcccagctgagtcctgagcagctaacaacaggatttgaagagtttaagattcgagacaaaaatgaaccaaaatccagaatgaatcctactaattctacttaagcccaaaagtgaacctctatcctctgtttaaaagaaaaacacaggcgttttcaaaaaaatacaaccagtaaaggcactacaaaaacagcacggctttctaaatatcattaaactgatcttaaattgtaatgcatgctaagtccctagcacatcacaggaacagtgtaaatataaacacaaactaaatgaagaaatgtgtaagtcatcttcatgttatctggtaaatctcatgtatgatacacttcaataaaatcccaaaggccagctattgggaatttaaaacagaaagggtgcttggtagcaggaggggcatgggtggtagataatgacagaaataattaaaggtagggactgagaggagattttttaaaggacaccaggtgtacgatttaggtttgccataatgatatacttgagtgaataaaaagtatgggatgcgggcgtggtggcttacgcctgtaatcccagtactttgggaggctgaggcaggtggatcatctgaggtctggagtttgagaccaatctgaccaacatggagaaaaccccgcctctgctaaaaatacaaaattaggtgggcgtggtggcgcatgcctgtaatccgagctactcgggtggctgaggcaggagaatctcttgaacctgggaagcggaggttgcggtaagctgaaatcacgccattgcactccagcttgcgcaacaagagtgaaactctgtctcaaaagaaaaaaaaagaaaagaaaagaaaaaaaaagtatgggataagaattcatgggtcatgatcaagagaaaaagttatttggctagttcatgaagtaaacattgcatccggcaaagaagggagaactctgaatgcctgaaagtgtttgaaatctgttctgtaagcaatagggagccactgaaaccttcaggcaggatgacagagccaaagctgtcctttaactgtctcttacaagattctaactcaaatgtgcctaaattctgcaaggttatttatctgaggagacagttcataatattagtgcaaaaaggtcgcaacagcaaaacaggaccctttatttgattaaataatttagttctaacacctgggcagagagaattccagtatagatgttactgtgcactctgaagccagactgcgtgagttctaattccagctctgtcatttactgcatctttgggcctgtaacttaaatcactctacgtgccatttccttacctataaaatggcgggggtggggagataattataccacctacatctcagagttttgtaagaactcaagtgagtgaatccatgtagactgctgagaacagtgcctggcacagagaagcagccttcaaattatgctgacacaaccacttctatgccataccctttgacatctgataaatgttactgtaacatttcatataaagtatcagaatatggattctgcctttgtagggggtgtgtgtgggaagggagacgagggaggagtcagatttttctgttcctatccttcaaaaccacaagctaaaagctatacacctaggtgaacactttccatttccaataggccttgtccatttttcccttctcgatggtttaaaatggttcccaggcacacgtgtaattaaattcattatcttaaaaaactgcttcaggaaatgcagcaatcaaatctgccaccatctgttttttatagatagatataattacaacctaataggcatcatttaatcaagacttaacaattaggttcttaaatccaaaacttgatcattttcttccttgatatgtgtacaaaattttctcccaggtggtggtcatgtaaagtgaaggatggaagaactattaaaacccttatcataatggccttcctaaagtgctaattattacacaattaagacagacataatatgactagaaagcctaagaaaatctaatgcaatctcacagaagctttttaaaatttttttccatctctatctccaaactacctaccaaaaaacccaaaatacaaaggagtacctctcgcctatgacttcttaacaagcgaagtcaggagtagcaccaaaccttcccctggttctaacatcacctagtcagatctttagaggagaaaagcaatcctatctgttaccttgtttcccatcccgcattttaagagataagaaacccaggacctgaaaagtgagtattttcctaaggcactcagggtgaaacctggactagaacctagatgtccctccataaaaaacaagattttgtactcttactccaccccaccacgtgagtggggaaaagcagagttttgagggcctacaatcctcaagtctgatcactgggtctctcacatctaattacaatatccagccccatttccaacttaataagattaattctttgtcactgatgctcaatagtaactcttgctactcccagcagccaacaccctagtttgaaagacatgcaggtcaccagtgcatcttctattgagagcccctaattgccttaccacacccaaggtgcttcctgctagactaagcttctttacagacctaacacaccaaataagagaccacagttgggcaagaaatctattaagaattagaaaaccctgaaagggctctatttaccactgaaaagaaaaatcttaagccctttgtagtttcccattctctttcctttcccaaaagctttaagaggtctcccagcaaacctaaaccaagccctcacttttaaacacagctgtccaaggactctgtgggtgggtgcaggggacagacctaatctttccctatgcaagatttgaagagtattagagaaacaaagcattaaagaaacaaaagccttaaagtccaatatttctcctaaaataacctcattaaggcaagttttctttggtcttccaaagaatcccaattcaaaaatgagaaaagaaagtagctaataatgagggcttcaccataaagcatcacaatcaacctttcattattcccattctgtaggtcagacatcgaaggcttggataggtggagtgactttgaatagggaccccaaattctgaactggaggtgtaacaatcaagtcctaaaacagtagagttcctattcctcttctcagcttattttaacaccaaatgtgtaacccagggtatctgctcatgcaggggcctaagtgcacccttcacaacccgggatggtagtgcccaagagcagctctactaagccagaatgagcaaatggcaccatgcttacatgaggagaaggacctcacaagctgcagaacatgtccagcctagcccccttccctcttattcaaggatgaagtgaaatgcactacagccctatatgcttaagatatcagatggaaattttaagaattctttcaaagaacataggtcattatccccaactttggaaaactacttcagattacttggttttggggagtagagaatcagtatagaatgcttctcaagcaaatgaatctacaaaattagaaaatttgacttacttaaaataacttacagtaaaagtttaaaactaaactttaaatttagtttgggaaaacagatgacgtatgaaattttttattcaaatacgaatttagatctatcttcatctgatacgggtgccttcaagggcaatgagccgctttttaaatctcctcagaggatcctattcacattaaacagaagccacaggaaaactggcattaacatttccttcctgcttgttggaaagcaaggcaccttatttgagggctttccagatcaagaacacattttataccaataaactttacagctgggcccagcagagatctacaaattaaggctaattgtgaactgtacagcaactgtccttcgtcttccatttttatattttatttcaatttggagctacctaacagacacagaagccctccagactatttctcaaaactttctgtttggaagtaggtacacgcacccaggaatactgaagtatgaaataaatattaagagcctagaacaaaatacaaaaacattactggaaataggctcaatatgttttaaaataacatttaaaacttaactgctgctttatttcttttaaactcaaagaaattttctcaggtagaagattttttaaagctacaagggatttcaaaatgaaaaactaatatttcttctcttgaatgttgtgcttgaaaggaaaagttatactgtcattcattcaataaatattaagctctacgtacaggagctattggaatataaagtgtgtctttgccttcaagggctactcagttttcagacaagtaaatttcttgcaagcagaaatcccagagtatcaatgatctcaccaacagaagtgtcctagctaagggactttagttttaaacagaaatcaacatcattaagaatgctagatgtcactgttactgacatttcttgatccagttagggtgtataaaggtcaacatctgacaacagaatgttcacgcattagttatccaaactaaaatgcagaaaatgtctaaatcagcacatttgaaactagaaagaaattaattctattacaatattaaatgtggaatcatacacagaaaaataaatgggcacccttcactaccaacaccccattttgcattttaaagggggaagggactcccacagagttttcttctaacaagcgctgcaaataggaattgacaggtggagccctgattgacaatggtggttttagatgacacctcacctccctcctccttacccacctaatctcacgactaatgcgggaagctgaaataaatacagtggaagattgtttatctgtttcgttttgtttttttaagtgcagatgtgttccacaattgaagaaagaggttaagattctatacacatcctgggtaccatttagtcaatgtctacttgagcaacaaactaggacaatgaaaccaatacaggaagaagaaaatgcatggagcaggtgaactactccgaggtgcatttttagctcatgtgaccttccaacgtgctccaagtatgttgtatgtagatgtgtgggcatgtatttatagaaagggtcaagagcgctataaaaaatacattaataatgttagtgctacaagggacttccaaacgctagcccacagcctcaatttttagacagagaaagcaagccccaagacttggccaaactttctagtgatagaatttgctagtgatagaatctggtcatagcattcaagttttcaactcctgaagacaatcttacctccaaagtactccaattccacagctttattcttaaatttacccctcccctagaaagatgactgcccactcctccctacaatacagattccaagttttaagactcagatgggcctagccctgccttccaagaatccattaggctaatccagtggttctcaaagcatagcctgggaacctaagagtcctctgagacttcctcatacatccgggaagtcaagagaatgccttttcctctcataaatgtacagtagagctttctaaaggttatatgtgacacttgcttctgcattcagtctgttgcaatgagaatacagttgactagatctattaagccagacgttaaagaaatgtaaaatgtaaaactatgccagccttactttttaaaaatatacatattcctcactttaaaaatattttttaatatgtaatgggtttgctatttaaacaggtttttaaactttctcatcttaatttcttatacagtaaatatttatacacataacaaacaaaaggtcctggggtcctcaataatttaagtgtacaaagggatcctctgatcaagaactttgagaattactggtctaattcactgctacataagcatgcctttatggtgaatccctttagcccatatagataaaccttagaacagcttccaactactctccttaccttcaaagggatgttcctccagctctgggactatgtaaactacttctcatgcccagtactaccctgatttataagaaaaaaacgtgaatcatctcaactgcctttaatgtaaaatttttacataaacattgtcggggaaacatgaatataactgtatattctggttctcagaaaagatgctttataaagcataacaagctattacatgtttcatgttgcatacttacactggtttagaaaaatgcttgagtatcttatgagtctctcctacacaatacaaagcatgccagaagcagtttttcactttcatttgggggtttacaccctagtcaggaagccatgcatgctccatcttcctctcaaagccctggtgcgttcctcctcaaggcccctttagccacatcagcccatgtcttttgcttcagttttcctcacactaagccatcctgtaaaattgtcccaaggctggctctctcaaacaaaataagagaaatgttcctgtatggatttcagtgtcctctagaaacccacccatgttccaataatcaaaactttttccttacatgctaggagtacaccacacttaatcctcttctcctggggggttgcgggtggggtggggggacaagtccccctatctgtataaaagagcttcacaagtgctactacatctacctggtttcaggaaccttttcccaatgtttgcagcagacctcaccaaactcccataaactcacgttttcttcctctggactgtcaaccagacttggagaacttgagagtggcatccacatcctagtgtttctgagcacccaacgaccatgcacaacgctcagctcaaggcaggcactgaatgctaacaaacagctcatatgtaggaaaagtgcaaatctattaaaatgctctgaaaagcccaagggggatcagcttttgaagtaattagtaattctattataataatttgtgcaaattaaaaaatatatatttgatgcaaaaagataaccacagaactgtttaaaagatggatttattatttatttatttatttattttttttttgagacggcgtctcgctctgtcgcccaggcaggagtgcaatggcatgatctcggctcacagcaacctccacctcctgggttcaagcaataaaagacagaaatatttaatttcttcaaatctacacctgagaggttaacaatttcatgaacactttgaacactttcaaagaaaatacaaacatgtaatggcacaggtgaggaaaagtaaatacttaatacatagatctttttgaatgctctctgaaccttgctttttacatttcaagatcagcacatactctttatttacagatactatataatagagatatataccctgattaatttaaccaatcccctactgatgaacattccaaggttttgctatttcaaacagtgcttacaatagataccttatacagtaaagcaaaaatgtaaatttaaagatagaaattgctggtttgtagtctatttgcatttttaattacgctagtcactgccaaaaaaaacttctgaaaacttatcagtttgcagtcccaccaaagcataacctacatttttaaaaaggaaataatgcagcagtgtagagagggcactgggggaagtaaaggcaagtcgggaaccagccacaaggtcacagtcaccaaccacaatcattatacctaagactttagacaatacatcttagcatcagttctgaatgtatatgaaatgagactgctgttcaacactatgggtagggcctttccagctctaacattctctgatgtccttgaacttgttatatataagaaatgtacattaaatatgaagacagaatgcttatcctcttggactacccaaggacaacaaataaatgctgggaaagtcagctgcaacactgggaacataaatgctctgacaaacccctgctaggaatttcaaaatggaagtgaaattgagactgaagaaaaagaccacctaataggaaatataaaaagccatttcaaaaatgataaacaaaagaaagacgttaatcatttggggattttcctagtttaaaacaaaccacatctccgtaaaagaaatatggctaaatggctataacaagtaagggccaaagcaccctcatggctactaataaataaaacggtacaaacatccctttcaagtctaccatttgagagagtggatactaacaagagatatgatttgctaagctaaataaaagccttcattaacaagaagtgacaggatcacaaccctgctgctgataaactgccaacatacccaaggtcttcaatgaagggttgcccatttaacatactgcagctttaaaatgagttgctttagaacgaacagttctatgtcaaggcaggcctacaacatacaaaacagatggagctgctactgtaccttgggcttgtgtgtgtacccatgcacgagcatgagcttggcatataccacaggagaacctggcccaataacgcttcttaaagttagccatccatgattagagcatctaccttagacctcaacttctctatctgcttccaaagatactcagtgtagagcagaaaacattcttctgatagccgaagagggttccacatggctattaaatgactggcccagtggtcatccatggagacccctccttattcctggcaaacacagtcatttcagtccaaccttgaagcagccaatatcttttcaatacagcacactttgaagcggtattaacaggtcataaatacatgtaaaaagcatagtttcagcttagtcaaagtggttacagaagcatcattgtatatttttttctgggtggtccaagtaaattaaactcaccaactagactgcaaacagataccataaattcttaattattcacaggtatggatgaaaagaaatagcactttaataaagtcatcttaaaatattattcagtatccagcacttaattaccatcatatagtagtgatatctaaaaaacatagaaatgtttgctatagtttaaatattaacaatttttattaactccaattggttaaatatgtaagttatacaacttcatagcaaccaaaataccaaggccgaatacacaattaaaagaaaaaaacttgcatgtaacatttaccttcagcatatataattttaatcttcattttaaagacataggacctattagattcaagaaatcagactagccaggtgaggtggctcaggtctgtaatcccagcactttggaagtccaaagcagaaggatcccttgagcccaggatttcaagacaagcctgggtaagatggtgagaccccatctctacaaaaaaatttaaaaattagccagttgcagtaaagcatgcctatagacccaactactcaggaggctgatgctggaggatccctaaaagcccaggaattcaaagttacagttaactatgatcatgccactgcagtgagactaaatctcttaaaaaaaaaaatcagtaataagacaataagacccactatattcagaaaacaaagttataagaatcactgacatcaaagagcttccaatgtagttgaaagtaacatttaagttgtgccctgaaaatttaaaccaatataaaaagctattaaggagagaccagacaccaaaggcaatgggaagttgttaccccaagtgcccattccgtaacagctccttaactctcatacctgctgtccctgtaatgccagaagtaaaattaaaattctcctctcctgaactaaaacttggtttacttctctccaaattccatcaagagtagaggttactgtctatattttcagtagcttccttctgcacctaaggaaaaggggctgaaatctaaaagctgtgatgaaataatatccacctacaaaaaaatgctatatccatgttaaatcaaacaattataaatggtataagctaaaaggcatgcaaagtttttattatcttcctaaagaccagcttatattaaaaataaaactgtttgccagagtccacctctctgaggaaactaagagcctagtcaagtaagcttaataatctaataaggtggtcagaaagacactattttaaaatatcatatccttgccatgcattcactgtactgtttaggtctggtgatctgtgtgaatgaggaaactagccagatggaaaattcacttcctcattttccttaaccttttttccgtgtcttttccaattgcttagagtaatttcccatattctacccatctcttacgaacatacctagccctttaggattaaggaactccacagaagccactgacatttttttaaaaagtatttttcgacactcttaaacaacaaatgtcttccaaagtttctacaaaaaaaaaactgcctaagtctcttccactccaacaaatattttaaaaacaattccaattaatatggtatttccttttagttataatttaaatgaatactggaaggaacacaatatggtaaagcaatggggtgatctgtcaaagggattatctaaaaggtcattcataaacaaaccaaataatccaatcaatgacaaaacacaactgtggatgaattagtgaaattctaatttccgccaagcaaaaagcctaacaaatattcctaagttcttactgcatcaattaatacattagaaagtgttatttaaacaaatactgataatatttcaaaatccaacacattttcaaagccatgggtaaagagaataaaggatttagacaatgcagatctcactgctgggctttgcattcaccacatagctttcagagtaaaagttgccaaattacgttgtcctgcaaagaacattaaaatcggtttctcgtaaaaaatataaaaagccagatccatggtgggatagaagctgggtggcaggaatcagctctaggactcaaagttcaccatcaatttatcaaggagaatagagtttaattttaggacctctgtctatccttatgcctataaaattaaaaactagtctgtttttatgtacagtaaaaataaggtagctaggaaggaaatcaacaaatgatcttcactaatcacctcccacactgtgttataagccttaaaggttattttccttcacagcacaaatcacaattatatgtaataatttgtagaactttaacataatatctcctccaataaactctaagtttcatatcagcagggagtatactgtattcactactatagtcttaatacctaaggtagtatatgtggcatatagcaagatcacaaatatttactaaacaaatgaaaatctgcacaggaaaccaagaaatgttcacatgtaaactggcaaaataattgcttttaaagtactggggggcagaaaaggctggatcagcaaatcaaaaactgaatagaaggacaatcaaaaagagcaaaatgccattcatgtcaggaggccagacacaataaaataataaaatgttaaatgctaggaaaagagagataagtttaaagttttaaagtggctactaataaaaactttagatgtaaacatttcaaatattcataggctatttaataaactgtcatcaaattgccacatttctttgagacgataacagagaataatcacagggaatgagagagagaaagaaatgttagccataatgaaaaattccttatgggtaaagttccagaaaattccttaaggagtctgaactataacacccaaaacttaacaaagtccctggatctcttaatgcttctgaattccatagggaactggggagctacaaagcattttacccaacaaaatctctggtagtcttcgccaaatttaaggaaacacaacaaaaattaaagagaaatgatacgtattaaggtcaaagtttaaggttactatgtcctataaaatgtgatgatgagtaaaatgctattgagctttcaccctcaacaattaacttctgcttcatcctgtgatattctaaattacagctaaccagtacggagcagccttgtcaggatcccacctgactgctttgtgcatagcctgttggccaattttataccagaggcacctgcttgaaatatgtagagacaatctgatgaccttattttctcacgtttacaccagctttccatagcacaaggacaatatttatactctaggaagagtaaaatatttgcagagataagaaatcagagaacatgttggcatgaagctatttcagcttctcaattctaagacatttggactgaaagatgcacccactaacctcacagctttgggggacatagaatcaggacattaagtaaacttaagagactcaaaagtaatataaaaattgcatatctaagacatgagaaaacatgggattagttaaggcagtttttgcaaaaatttccctgtagagattgaaattctagtaagattacctatcattcatgatttacttacatatgcaaataattttcaattgattatcagtctcatgtactatattctttctttaaattattatctctattccagacttttgagttctgctgttccagtgacctccacaaattttcctgaatttctcctaaaaacacactatgtgagagatcaagtaatgaaaaagagcacatggcctctttctagggaagagcaaaaaggtcattttgaatctgtaattctttgtcatccactcccaaccaatttttctgacagtaaagttggagaaacagtaaagttggagaaatactgaaaacttactggagaaaggtgaatcaagaacaatctttactgggtgaatattttgtttattccaatttggatatcaaacatcctattgaacacttgacctgccatttttttctcagaacaaaaagtagtatttctaaaatcctgcctgattgggaacacattttttttcataaacttaacaagttcaaaaaacagcccttacagattatctactacaatgagccagggttatctcaatgtcactttcacctttttcttgattttaacagcatcctaaaaaaagcctgaagacagtgtcttcatttccttgcttacagaaaataaccaatccatactttgtatggttccaaaaagtaatcctgcaagtcaaggatgccagctggcatcagaaagtcaccagcctgtgatggaaatgcctccagaagtcacccagtcatggacctaaaataatccaaggtcagaatcctggccctgaggaacaagttgtgggcatactgctaggagtgctacagggaccacagtgaagctttaaaaaaaattataaaaataaaaaataatcctggtacaacaaccccaccactggggaaccaaacagcctctaaagcaatttaatatggaggtgagatacaattgctgctggagtcacaccattttatttcaaaacacccctaagagaagcaatacattctcaaacatgaaaactgagttgcttcttggatctgatttcagccaccttaaactacagccagcagaactaccaaaagtagaaagaacatcattctgggatccatggaaagaggtacagaactaggagtctgacctgatcctacttccccacttggttgtatccttgggcaaaccacctgacctctgagcttcattttcctcacctataaaacatcattcccagggagctgtggcaagtttctataaggacagaaaaacttggtgttaatcaccattactagaggaaatgctccgtgtctcctggttccatcaccttgtggtagttcaccatcttcaattgccaactccacgtatttttctatcttcctaatggtaagtcaacaactaaaaagtggcagatccctgctgccccatcccaatccactgctaacttgactgtccaacacaaaatttcttactgttgcattctcaagggagagtcatttggaagttaccatagaagttgtacaaaaggaaaaccaaaacagatgtcttcactcttcctgtctaggtcacaaactattattcactctaaaaccaaagatttcaccctaccatccacaaaacaatgtttataagtcagccaaactgtttgggaaaaaattttttcaaaaagtccaagaaacaagaacacaaattattccccgaacagccagttccaactgaaggaatgagcctctccactaaatcaaaaaggtaacgcagcgtacaagctgttcgatcacctttcaaggaaaaaaaaaaaaacccacgaaacagtaatgcaaatgccattaagggagaaaagcagtggccaggcctcagaacaccaagcactggcatgagaaagccatagtcagcagcccagacaacacatgctcctggaagacatggccttagccatgaagatgacgcaaggagaaggcatagatcaatgctctgaaaagcaccccagcttctgtcctgttacttgcttcttgctcctgcaactatattcccaaaagggaggaagtcaaaaaagttgtaattattttgactttttcctaggtgttttgaaaaataaatgttatacccagaggaggctgctggcacataatgttgtcaacagaataaaactctgggggaaacacccagcttcatgtagtttgaaacacaacgtgcctcagatctactcttctgggacaacagtggaattaagacagtcacagcttgtctctctctagccacaccctcaaacttgagtaggttttgcagaaatacttttcacctgtgactgagctcctggcaaactaggaaatagttactcataccataaaagaaaatcaaaggtaacaaaaacaatatgggaggaacgggggagggaaataagacataaaaagcaaaaaatagacaaaatggaccaagaaaagacacagtcctgtccctaaagcaataagcaacaacctggcctgatcccttgattcccagacaacagggatatatctctttgcttaattcctcaagcactcagtttctactattaaatgcaagagtggggagtgtgtgatttttttttaagttatcattttctgcctcatctccttaggtagagaccaaggaatatgaggtaaagggcactttatacaagtctcaacgttctcagtatccagcactcagtaatttgtgatgaaacaataagtattacacaatcttcctggcttctgaacataatctcaacacaaaacctagaagaatatttttattgatccttcaacaaactcaaaaacaaaattagattaatttggaaaagccctaagcttcaagttaactagcagcccacatatatcaaagtcattcttattgcacagtagaagctccacgggaatgactcccaatctttagggggataaaacatgcttgtttttactgatattcaattccccaccccaacccagtaactaagccaccctgaggtgccgcaatgagatgctgcagggagcatcaaaaacaagcaacacgttcacctaaaagaatcatataatcatagaatagaagatgcttggtaccaagaatttttaagtgcctctgaaaaataagttccaaatgtacctacaatgattttttaaaatcatacacagttaattcaaaattaagtttttaagtgagcatacacttatactaacactccaaatatcaaaaaaaaaaaaaaaattggctgggttgtagagtaagccaatgcttaaaactgccaacattaagctattattctgaagggttttgctaagatgttcaatacaggggcacattctgattcatcgttataactggcctagctgaagtggctgccaggagagcagggttttatgggcattgttccatcctaagaagctacattaatgctgggttgatacaacagatcttcatatctatttaccaggctgaacaaaagttaactagaaatgtaagtgcttaaagtcaccaaaaggaaggctccacactgacattttctacctacttagcattcaactatattcatctcactagacattaacacacaccaaagttgctctctgctattcaaattgtgctattatgctcaggagtagattaatattatccaccttccttattgtaaaataaaattacagcattggtccaaacatgacatgtggagcctctttctacttctgctggtgcatcagtctgctctacggcacacataggagagggccttgctaaggctgccctgctgcttctggagtgggggagaaaaggctgaagactgaaaaaaataaaggggaaagggagagaaataacacacacacataaaccacacacctggaagtctcatatcggctttttttttttttttttacaacaatcttataaatctgttgtcatttataagctcacaacatcagcaatgaggttagcaggtgggccacaggcctcttttaaacagctcataacatcctatcagtttttacagcatcaagtagcaatgttgaccccaaagcatctgaataaatagaagcaggcaactggcagggagaaatccctactcccaatggggacagttctaaaatcccagggggggaggagagaaaaggtaagttaagctgagagaagctcattttataaaaggagaaactgtttttcaaccacgggttaaggaaggagagacccaagacaaatcttctctgaagtaaaggagactataagatctaaatatgtaaggagcagtttaacatgattcaaacattatctgtaaatacaagagatcaaacgaatataaaacctttagaactactgcctttgtctttacacttaactttttaattcacgtggctttaggaagtatagcattagagacaccaaggccaggcaaacaaaccaaggtcaaagtgaaacaagccatgcttcatccttaaggcgcagtcgataaatgtggactccattgttgttgctccatccttccaagttttcaagaagcaatacatttggctccagatctttatatattaccaaaccgtaaatcaacaactcacaactatttaaaacacagttcagggcaatcaaaacacctataggccatatgaagctcacggatcacccttcaggacctgtggcacaaataatttgtccactgataccaactgctccttctggtatcagtgattcacttggtcacagaagatattcttcagtaagtaaaatgtaacaaagtgcataagagccaatgcaaaagcccaagcaggataagaaaataaagggacaagtgagcaggttgcacctgaccccaaattaccaggacctggaactaagcacaaggctaaaaggataaacaagggacagagggcaagtacagacgcatcccaaagaggggaggaaggctgtgggtagttcaaattccttgcggagactatggagaagggaagagatgaaagtcaaaagcactgatgacctcgtatttgggaaaagtccatgggtcattcagaggcacaggacagaaaagaccccaagggtttttaaacaaaataagccagcaatcagtaaatagcacctggggagatcaaaagtggtgttgaataaactcaaatagaaataggccttacctgggaacaggttataaaatcttgctccctctataataaatgttgtatatttaacacattctggatacctctgcaataaaggtggatgaccccctcacctgccatatcacctccaataaagcaatatcagtataacaagaaattcttacttttgaaaagcagctcagagaaaacaagatcaagtgctccagaaatattttcccatccttacccaattcactgaatttattttcagatacactgtgatttgctttattctgatatacacaaatgatgcctaaagaataaaaaaagtgctaaacatcctttaaaagctgaacaagtgagcaatttccaataacttacttgacagggcatccatcaatgatgttcacaccatcagcaatgaggggaaaaaaatgtatttctatgtaaactccattttgtgatgtataggaatggatccttgataagaggttaaataaaattcaaatcagagaaaacgcggactattttaatataaatggttaaatttaaaattttgatttttcactgaaaaaaatatgagaaatttaaattaagaaatttatattcctggaatgttagctggctaaattctcagtctcatatgtaatcttttagcattatttatattttcaaggaaaatgcattttaaactttccaagtcccatcatcataggtataaatatgtctatttccatactgaaatgtccaaagtcacaattctcccaaatcctccctgcagtctgggatttttcttttacttcatggcagaaataaacatatgatggtgtattataaaaaaacaaaatcactaaaaatggttcataacacattgaaagccaaaaatataaaactaatcaagcagtaaccacctactaccacctttccaattcagtcaatgtcatttcattgtcaaaaaatcttgtacttcaatatgctcatctttacgtggtccttgagatggggagggtaagattttatacacaatcaaaggttaagaaaccaaggatataagtaattaaaccaaaccagatgctgaaaacttcagacttctagcctactattttccacctggctgtgctaaattaagaatttcaacctaagtgacaaaacctactgagacaactcagcaaattggccgcacgggcacggtgatcacaagaccttatgtgtgtgattatttgtttacaaaaacagaatggattttaaaacaaactatgagacaggaaagcttagagtcagtcatccttcaaagaatgctaaaggcccacatcactaactcaacagcagacaagaacctctgaatgacttcacccagttctcactagtataagaagacaactctaattgccaaagtcctatttcccaaatggaacctcattttaacacgctttcttccaaagtgcaaaatactaaaaactgtatggaaatttcttatttgtatatatttctctaggaagagacagctacagctttcttcaaatgcttaaagagattctagcccctcaatattaacaagaacttccaattttacaatgactctaaagaaatgcaggaaagctaagaatctcaaaacaactatcattccctagtcccataaagagatgaaattagtcaagaaagtgtgtactaaaagctttcagtaaaaaaaaaaaaaaaaaaaaaaaaaaaaaggggataaaaatccatcttgaaggaatagtttattgctttgatatttataaaagatttttgtgatatcctattaacatagtctttaaagttgctgaaataatctccaataatgaacaacccacaaaaacaaaatgctggaagaaaagaacatttagaatataaatttccctttcatgataaactttttaagtcaaaggaaaaacccaaggattaaatctatcactacagatggtccccaatttatgatggttcaaacttacgatttttcaactgtatggtgatataaaagtaacacacgtttaggagaaactatattttgaattttgatcctttcccgggctagcagtctatggtaagagactctctcgatatagggcaatggtagcaagccacagctcccactcaggcaatggatcatgagagtgaaaaatggatactctgtgttgccagatgattttgcccaactataacataaatgttctgagcatgtttaaggtaggctagactaagctctgatattcagtaggttaggcgtattaaatacatttttaacttaatgccattttcaacttgcaatgggtttatcaggagcatctgtattagattggccaacggaaaaatatacaggtacatcaaactgtagataacatacctggttcaaaatataccagtgctaaagcaaaaccttcactgtgtcttaaaaaaaaaaacctatcattttactgttactgtcttacagtaagtataattttaaatttgtcaagttttttaaaatacatttttaaaagtgggaaaggggattttgcatgtcagaccttatctcctattcattttcagtcagaaactgatgtaatagatatcagtaatataaatatatactaagaaactgcaagtttatttaaaaaaaagacactgtaaggcattctataaactggtttagttttatccccattccacctattcttatgactttctgggttattttacctattttactcctcaaagcccccatccttctcttcataaagatttcttacaacgaaaacctgtatctgttgtcacacagaactattcagcaatattcaaaaaggtaccatgtcattaagcatatcaattcagttcacgcattgagagcctaactcaaagctctgagaaaagaatgctcgttgcaaaaatagttatttttattaagaccaatctctagaaacttaacattgatattaaagatgaagatgtctatgagaatgcatttagcacagcgttgctcacacaagagttaccttttgttttgttttgcacaatggaatacaagcttagagataaaaaaaattcttcccttgaaataaaaaattcttctagccttactaaaatgaaacatatgatacacatcacacaagctgaaagccaaatctgttaaatttactagtgaaaaatgtcctaagtaccccacaaaaatctaagattttattacgcaaactttgacttttaattcagactccaaaagttatcatttaaatcataataaaacacttatcttttaatatgtaaaagccttaaaataagcactgcctttcaagcttaagtgtcttctgtttccacttggcaaatttacgttatgtgaaatccttaaataattaactagcactataaaccgtctagtatctcgaaccaaataaatatacaataaatgttcttcccaaattagaacatacaaaagtgtggatttggcactgaactacaatatgtgggctctgtgcgtaaccagaaccggtgaagacttctacacctgtaaaatgaaaatggccaaagcaagaaaaaattttatgcattttatgtcctccatagtgaatttgatagtcaggtgtggcatcactagacataaagccttcaaacagttctataatatatcaacaaagcagcaatactgacagctaaatactaacaagtgggaaggcaactaaccaggaaaagctacgtaatctgtgggtcccagtgcaagatgaaaatgcagggtaaccttgtccaaaaattcttaagaatttcaagattgggtaggatgtgcaaccataccggttacaagctggaaaagcagtcctgcccataactaagtactcacgccaaaaataaaattaacctccccccacacacactcaaatgtggtagcttactatcatttttgacctgtccagctgagtagccaagaaacaaagagctgggggtagactgagatgggcaggttttccacagggtggcacaccatctagcccccttaaaatgtcaacaaaaaagtaaccaaaccaagctaagtaccacagattctagcctctctcaattccaaataaacattatgagtgataaaagtggcaataagaatgtgacgatgtgatagatttaataagacatcaaatgggagcgaaaatactgatgctaccatgcagacaagtcatcaaaaaggggaatggtaaagtcagtcttgataagaagcttaagaagctatttcagagtatctagtcctttggggaaaaagaacatgaaggctaatttgccactgtggtgctcttgtgcaatgccaataatgcctgaaaagcgtcacaggttttttaaaaaaatgtctttcagcaaagaaagaggaaaaggttgatcccagcttaaaagtcaggatattctggaaggctttgctgtgtccttaaagagaacctaagacttgcttctagaatagaagtggggtggcaggaggggaggcacattatttttaaaagataagcagggaaggctggaagagccaagagcggttggttacaaggattcagctagcagcatctgtctgtgtataaataatcaaaaggttgattcaaggaatgatggtatatgacactcacagcatcattctcccttaacctaccaggagctgagtcttaactaaaaccactgaaactgggacagaaaggctttgtttttctcttgtgaagaggcggtaaccagaacaaatcaaccaaaaaaactaaatcagagaggatctataaaaacacatcttaggcctagaaaagaaaaaaggttccatagtaaccttttgacactgagtgtcaaaagagtggtagacactgaccagcagtgggtacttgctctaaacaagaagcatatcctataactaaaattatcttgaaccacagggaaagtgtgtgagcactgaatatagctgacttgattgttcctgaaagaagacactacacaatgaaggaaacacctacagataaggaagagggaggggcttaacacctaaagttgtctttcaaaggaagaaaaaaacaactaactccctgaaaggtggcagcacaaagttacccaaataacaggcaacaaggggctggttttaaccacacaaaaataaaaatactctctcaaaaaggaaaattacaaaggaggaatcacagaaaatttaatgtaacatgtttcttcatattctaatttttcctaccccattctggcctttatcttccagatgttttcttcctcttctttctctccccatagtttgcaagcgaacttcccgtaagtatatcctccccacaaccttaagtgttgttaccttagcatccctacaaacctcctataaagaaggcccctaccacaaatgcagtaacattcgggtccactcagcaatacagtcaccatttatatatacccaaaggttactaagacaaggtagatgcaggacagcttttccacccgctcaccaaaatggaaactccaggtcagcttccacaagaaatgggaaattcaagcgactctggcgaaacgattcttgagaaaactcttcaagggcaacaaaacaatatttcaaacaaacagattttacttgagggaatggggacattacacagcaattgatattcgaatggttttaaatggactgattcgccgtaagttttgaggctgagctaaatttttatgaagaattattaggaatagggccactagaaaattaagttttaaaagcgcttttgtccttgccgaaggtattacattttggcacttctaagaaccgttctttgagggagggaataaaggagagtggacaactcgtagcaaatccttttcccatgttttcagaaaatgtagagacgataggacttgaaaatctttgtcataaagatggtctttaaaaatgcacacaattctaaatgaccatctgggcagctacaactgcatgctcatagctcgcatctagaggcatggttttacgctctggccctgaaggataacaaggaggcttttaaggaaatgccgtgagaaagactgctggctaagcattgtcacggccactggaggagcacctgccagtgaaccgacgctggctcccccagtctcaccagtgcacgcacactagtccgtgcaccccggccgccgctggcaggccctaccagccaagctggaggagcagctgccgcaaccacggcaagcgaactgaaatcccagagccggcctcgcccggcagagcgcccgcgcttcccgcgcagcgcacgcctcgcgcgcaaacccgagatgtgaccgcgagctgcgacctcgcgcggctgcgacgggcctcacctaacgcgcacgaggggatcatcattgctcctgccctgggcgcccgcggccctacaccacctccgcacacaacgcggccggtgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgcggaggagtcgctcggggcgagctccgcggagaggcggtggcggcggcggcggcgggaaaggggactggaagccggcggaacccccgccccacccgcgccgcgccgcgccgcgccggcaaccgccctcctcacccggccggctactgcctcagtgacgcccaggcgccgcggtcccgccgtttgtagcggggcgggaaggaggggcttgcttggaagagcgccaggaggcggggccggcggcgagttcgcggcgccgcggccgccgccggcgcgtgccctgcccgaccgcccttcgggtccgtgccggcagggagatgccgggcttcagcagctcagctccgtccctccggacttccgagtctcaccaggcttccccgacaaggtttctctggactcggtggagagcgttgagcgcccagaggaggctgattccaggtgcaagtttgcaaatcccgaggcccggggcgctaacggggagtcagagcagctaacgtgggggttactttatgtgttcataaatgtatttataaatatatataagtatacacacatatgtgtgtctcttttaaaaattctctttttccccctacttcgcagccaaggggtcctgtccctggacagaaaataaaggcttagccccctgctgcccctccctgcctctctagagagaacctgacgtttaaataagcccagagtacctgtgcggggtgctgtactctgcttcaaacgcaaagtaggaaatcctgcactcgactatgcaaacgcttgccgctagccgcatccttctatcgccccccaactcaagacccgaaatggccaactcttcaccgagggggcgtcccatcgctgccttgccttggcccgccccttcgccaagctcaatcccttttccccagaaaaacctgtgcctgtcctcagacccggccccacggctggaagtcaaaacccaccccggagccacgcggctggagcacgtttttacacctgctcggccgcttaattacgagagcacctgtagttgggatttttttcattgcaaaggcatcgattttagcccttctcctaaaatactacatttaaaaaatcacctgtcatacctacctgaaattgtaggaggtaagagaaaggaaccgagcagtgggcgacccagtcgccgcaagaacgtgaccgaggttacagcttcaagggcatgatgcaggtttgatgcagcaaggtccgctaagggcgtccagcgctccccgcccccatgcgacgggcggagcggggttggggggaagggaggggactcgtctaacccagggcgggtgtgggagaggcaaatttgccctcttgggcgaagtctaatcagcatagtgaagtagggggctcaaccaaggtcaaaagcgagataggccatcccttaatttgtgcgacccagtctggggacaccggatacagctaactgattctatatcagcatttccgtgtcaccccaaatccgatttgcaattaaatgaccttaattgactttgtgtgggttcctgggaaaactgctcaaagcgcctgcgcctctttgacctctcagtaaatagttaattataatattctcatcccaggcacgcgggattgctaaaaatgcctatttccaaaacgttaggcgaaaatgggcctacttaatttgtcaatccaaacctaaaactcttagaatgccctacgccctacttcctgacgctgactaaattatgggagagctctcagaagagttccccaagtcttccaaaccacttcttcctacaaccgtagcgttttttgtgaagagctccagaacaggttagctttatgaagcggggtgcccaagcacttggttaaaagagggaacggggaagaagtgcctgctgtaagacacattcaggcaatgacagcaataagtaagggcgagagttaaaaaataaaatgttaaccccataacaacttcgaaactctcaacatatttttttgcgggcttatctgttcatagtctgacaaatctttcagatgtcccatttaagaagccattttacaaggaagtcttaaggcccaaacacatttcctacccttctgttccccaaaacacgaacaccctttttctgacctttagaaactgattttcaatttggaaaataatttctttagttactattgtctgctgtgtactttctaaaaattttcattgtaagtctacgttttataggttgcagttaatagtgtaggcctgggaaataaaacattaatctccctcccacccccagaggatgggtataataaataggggtgcggagaacggctgaaggtttagaatcttaaccaactggagtgtttgtacatgagagggggaagggacagaatccgtgcatttcggggagaaagtacagagacctccatccctgtccagcagtgttaacagtaaatactaaatggttggctatttctctcaccctcgccataataaaaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacactcacccacaccccctcgtgccaataatttaaacttctcttaggaaagccagcagcttgttccaccaccaccaccccttccgccctccccggcccacgaacatcctccccctttcccacatctaccctggatcctctctttggcagtagaaagccaaatgatttctcctaaaccctgagaaatcacaaaagttaaaatgaagcgtgtgcctatctgcccagcttgtcatccccaaccatctttctcctggcgtcaatttaacaatagctattcgaggaagtgggggcggtaaggagggggtgagggctacgtggccgagttggctcctggggtggctgcgaagcctcgcggctgcagaggggttccccctctccccgaaggcgaagtcagccgcgtaggaccaaggacagggcttggaatccacttcccagcgcccagcacagcgaggctcccaagcagccggcacttcatagacacagctccaaggatcttatttacgcttttctgaacaaagggaatctcatatccggtacaggcttaagaattcagccccaaattggctatcttcttttaaaactgaattatgataattggagtccgtgaatcagagcccgcatacaatgatgagttctgacagcttctaacaaccctagcctcagcccagccccagccccagccctcaggcggcatgtacttttttcagtcaactacaactcgctgcctggtgcagcatctaaattccatctggcaatcccatctccccagcacatgctatctggttaatgcaattaagcctgtggttttcgctggtctaatctgccagtccaggcttctgattccccttaatgattgtaaagcctctcccgtccttccgttgctgagccaaagtagaggcatgcatccccaacacccaagttatcactctctccccacgaaatgaacttccgatctcaatcttgaagctcactccacatctaacctcccattgtacccctactcccccctggccacatttaccacttaagtttctgccatggacatttacgaatattcagtacgctaagcatgcgtccaccgtcttttagtctagctctttaaaattaaaaaagcagaacagtagctttgaaatgagacaaacatgtgcaattaacttcatattctgtattccgctcacttacaggttttctgggtttgccagcgcatcgctgcaactaatgattaaagaaaccaaaccgaaacttacctttctcccttaaggtttttgtgtatgtgtgtttttaaagtaacggtgcagttctcccaataaggatgagcaagaagctgctggatagttctcttaagacagcacgaaacctaaactgtgctcggcttaaaagaagcaaataaaaagaaacgctttcgaccccaaagtccaatgctaaaagaaatggcgaaaaaaaatatgaaaggggaggggaaacttaaaaaagagtttaaaaagacggagagactaccctcctattgccgttcaactaaacaaaaaggggcaagaaaaacaaaccaaggaacaaagaaaagagacgaaagaacgttttttcaaaaagacgatgtctttctccttgttgctttttagtaggtcgctacaggagtaagctgctgcatctctaactaagaacagaaataggggggaggacgtcttaaaagggaggtggactggaccacagatttatagcaccgtatcaccaaccccttctctgcctccgcactgccgtgtgtgcagctgctctgccaggctcctatcccgggcagcacgcgcggaagtatacgccgaatcgcgccacaacgtaacttgctcatcgccccaggatcctgattggtccacacgcttccattgaggccgcccaggcggggccgcgtgagacgattggctatgggcttgtgtcactctcgagagctcaatggagtcccgtttcaaggtaagttgtgcggggaggtacactcttaacactggcggcgaagggaaatgcaagaagcaaaaagaaatgtggagagagcaacgtgggagggttggaactgtactatcagagtttgcgatatggcacgatctcctttcctcttaaatctttctgcttcagaaagattcatttcctttgccatcactgctgcatctgtggcatatttctttataacatttaactctgtccggtatgtatgagtcattgagagctccctctctttgatctgagtgaaagggatgaatgtacatccattatttgcccgcatgccttttttcgatttgtgttcagtactgtattttgtattagatgttaggtaattgtatgtctttattttaatatacgcatatttcagatttatgtgtccccatgaacccctttttaaagcatccttttaagataaagatgaagtcagaaatgctctcaaataaagctgcacggtttgaattggctttcacttcatgttagaatagaaaagtgtaggataaatatcctatccagaaaaagaggtattgagtagagctaaggtccttcacttcgaggtgtctaatgattctcaaaaagagcagctgtatataaaactggaacaagccactcctctgcatttgcagacaggtacagtccttggaccacacatgtattgctgacagcaaagatagttgaacctttatcagggctctttctgtgaggatttaagaagtttaaccagaagaccaagtgctatcaatgcttctgcttcatagaggaagactactttattacaaccccatattttaacagcattcaggagaccaaaatacagttttatgcatgataattgtttcttcctctaagtgaaagtgaggtcctcaggatcgtctggatgtataagtagacacaatattcatttgacctacgttcttttccagccagcatttctcttttcaatcttgaaagatagcaccaacttcctagacagtttttaccattcttaccagaatgtgtaaatgtaatgtacacattacattacacatgtaatgtgtcttaaccagaggcacatgcctttttgaaagggattcctttacatatttacaactagtcgctatctttgagaatgccggaaaaagaagacacaggtaagagttagagattgcaaaagggtagggtgtcatggaggggaatgggacagaagatcccaaagcaaaatgactttgaagtgaggaatacagtaaatcagtgttctttgagagtgtccttgagtgttgataaatgattaatggtgaaaaacagacctgtttatctcccgtgtagcctgtataacaatatacgagttctgttactttgcatgacaatacctggggcttgagaaagaaggcctgaatctatgttatcttataattagtgtttataaaatcatgccttaacctccacccccagtttttgtataacaacctctggagtcttaatttcaacttaaaactattctctagacctgggtgaaactcacagcaagaagaaagaaaagcactttgaagaaatggagtcaagggggaaaaggaagactccaccccatctagactagatgtatgaataacagaagattgggtttgtagtcatcttccttcaacccctccccttgtccccagctccatacagagaaataacctttaaatgaatacaatttggggaaagtataatactgtttgatttcatcagacttacctaggcagtgaattgtctttcctcctttttaccatgctcgtaggttaatattgaattagttgcatatgcccatataatttcagtacattgaagtaaatctttaccattataattatataagtgccttctaactaggtggaaactaatactttttttggtgcatgtttatatccacaaaaaaagacttgtagataactgtgatatctgtagataacccaaaatgatagggacaggtgtgaaaagctgggagtgatatggagtaataaaaatctagcatgtgtattatgtaaagaaattacatggaaaatagtaaacttgttcattcaaatgaaaaatgctaaattctgtagattcagtatttatggttttttttcagcttgggcatagtgacaaaatattattcaaagtattgtcatccctaacatgttgtctttttatgtaggtgagatggacttaaattatttaaaaagtgaaagtatcttaaaatattattttacttcctcattaaaacagatgtttttacattttaaaacttttaaatggatagatgtattataagcaacatgtactttttcaacttttaaaaataaaaaatattgattacagcctctttaaaacaagtgatatctggatgtagatttcactttgaaattcatgtctcatagcttgaaacattaacaaatacatactatcctatgattaattaatgaagcctatgtgcaaacatctcacttaagaataagcaaaaaatgcaatcaaccccttttcactcatagtttggtaaaagaattatccacaacatctgaatttgcattagaaagtatttaaaagacatttgaatatgattaagttatatgaactctgacatatcttccaagttcctggcattattttgaattgcagcagaaaagggagagatgaagggaatgactgcgaacttggagcaaaagtgtgaggtggataaagttgcaaaagaatagttctcaaaaccgaaaaagtcatgaatttaattattttactgaagtttctatataagagaacatttattcataagaatatgcaaagctgttgtggaaaatgtcttttaggataaataactcccttacactagaggtcctgggagcaagggaaggagtgattttacattttgtaataaaagttactgtaaactacttgtaacgttttgtaagtaaataaagaagttaaactattaaaattagtttacaatgtttggcttaaggcagtaatttccaacagtaaaccttcttagatgaataaaaatgttatgtgttagtatggtggagtagggggttatggttcatactattggaaatatgatagtttaatgtctgcatgagaaatacagatatcatatatcttgctgattactcttttatttattcttcctaaagtagtatgtggacttgcctttcaccgaaaggggggaaaagttgtgaaaattgacaccagtgtgaatttataccgtggcaaccacgcaagagaaagaggcaggaattagcaccatggacagagacgagcagccctcaaattaagatttgcaaagcttgagacggtgttttctgtccctttctgtgagacacggaaactgcgtgtcttgggaatgttttattccacgggactttgcggaaaagactgtcctactccacagaaactcatttattttgaattaggctggcatttcttaggactcagccatcatgacaaactgtcaggagacttagagccccgaactcgctgtgcaccttccactgtcctgttttacatacactcccttgccggcgtgagctcgcctttcttcagagtgttcatgaaaaataaatgcaaatccaggtagtcttcgaaaagtctggtaaacctgctccagagtttttaatcctcgaatatcccagctggaattgcagcaaaaatgcctgcctgctcacccttgctccctccccccgttcttctccctgctccctccaccccctagcaaaggggtaaagccttttactggaaggtgagtgactcccaagactattttgcgaaagattctttacattgcaaacactttcgttagggacagtgccaggggcggcagtgagcgggatctcaaacatcctttactttctctttacattgtgtctgtaaactcctgttcaagggggaaagactgtaaagtaagagagcacactcaaggaatattccccccgaatcctgaggttgctgtttacacttaaagacacatgaattgttcatttaaatgttcttttaaaaaatgtaactagtgtcgcggtaaatctttgagaccagcctaggttggttctcccttcccagccccccacttacacacacacacacacacacacaccttttttttttttttcctggaccaatgtatgaggttcattctcctttagatgatttgcctgcagatattcagactaagatctgttgcacatgtcccagagtgtctaggaaaatatatttgcagcctcagatcgacgattattttatgtagacgctcccacaaatgtccccagatttccttcccctcttttactcaatagcaacttttaggaggataaactcacgtttttcctgagcataaaaagggaaaatctaggcgactaggcgagggtgaaggaaaaaaaaccccaaaaaacccggaggtgaaaaagggcaaatcagagacttatgtccgtttctttcagggatactaacagccttctttaagcttccccctggagccgatacatctcatgcaaaattaatacaagcaattaaaaataacagtttccaaagttaaaggaaaccatctgtctcagctgatagtaatcagtcttttctctggcccctttaccgggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcctcggctctcacacgcgctcacacttttacccccacgtgtgttcagatcaaacccttgtcccacagagcaagtgccggcaccgggccacggtgacaaaggcggagtttgtatcagaagaagactgaggcccggggagacacagcggctagagaaacagctgtcttatcagcccgctgcagagatggagatggcttgagaggtcctcaacagataatcacttgaataggtttgcaatgcgccaaacttcacgcttgataaggccaacccaatgtagagagaagcccagatcctgctccattctatctgggctgtaaattaagaaattgaaattcaggtggcagaggcagcagtctgctgatagaccgctgaagtaaactgcattaaaatgctttcggcaggcagagggggcgcctggaatggaatattgtttaaaaaaaaaaaatgtagtgggagggggcagtgagagagaagaaaaagcccacggggcttaaaaattatttggggaagggaagctgtgaggagaagtggaaaagggacacagcatctggccatgattcctaatcatagctactatgaataaacaatttgaaaagtacagtatggagttgtgtaaagtttggtgtgataagagatcaaggaacaatttaaaccaatctggtataaaagggaattccgtctttatctgagcaggggtgagaggaagtggatatcaaatggactgtaaagttttcctttcattgtaagaaaagcagatcaaccggatacagaggagttaccataaattgaagttaacctggccttttggctgaagtgatagggccacgggagagattccagaatgatttttagaatagcctaagaagttgtcatccacaggaaagaatctacatagctacttacaggaataacagttatttttcaactccctcctccctttacccaggtaattactataggataatacaggaaacaaaaaaaaatcccaggtatgtactctaacacatacctgattcttaccgcacactttatatctacatttttctgtctgctcttttggatatgaggtttgaaattttatgcattatttaaatagatttttttcacaaatatttaatatatgtaatgaccagcatatagccagtgacactgtcatcttgattcactaatgtcttagtgttgtaccttgttctttgtgtcttaagtgaattgcaagttcgttggtgtccatttatgaggtggatagcaagtatgagaagatacatggcattttccacaagggcatttacattttaagtcttagaaacatttataaaaagttaccttcagccgacaacacatagttaatacagctttagaaaatgaatcaatttttattttgtttaacttcaaaaatgtgatcgatctcagaatgcatttaactgacaatataaaggcttatatcactttaggataagcaaaaataaaaaatgaacttgttggaaaaagtgagaaaaattttaacatgctatcataaattttagcaactattaaactacttgaattaaaaacaattataaacttggaaattgttatttgattattcataggttagtaagcaaataaatataggtcatgaaatctcaaagacatttctgttgaattgttacatgcaaaaatccttcatatctaacaaaaaaagaggtgtttgcgttttttttattcttttaaatttaagtgtatggatgaattagtgctttgtgtatcctttaatgagagagaaatttatggttatgtaagctaacttttcctttccataccattattttccataaagttatattggtttaaataatggctactatatatgtatattaagaaatattattttaatgaattccagcattttaggcagtattatattatctccaataatcccataacaagatatttttctgcttgttagaaaacaagtttgaattaccagctttaataagccccttaagctatgatttttatttttttcttaatcaaattgaaaatatgcacacaatggacagcttaaactgttctttaatacagataagacttttttaagatgttaatttgcatacagatgaaaagatacactgtcaccaagtttgaaatgtgaaaaaagatattttataaatttaaattatagcatttcaaaactaagataattttaagaagtgacattttcattatgaacataaaatcttttagcatgaaattagtataaaaataatcttgtttttttataaatttttgtcacaaaatgaatgctacatatggtttctaaaggcatagcaattcattataaatgatgaaaaataaaaaataaccaaaaatgtgaagttagttttttaaatgattttcaattattaatccccctctgtgagaaatggcatattatatttttaaagcaaacaatcttcctatgatgtattaaggcaaaaatgttggaagcttttgaaatatccaaaagtcttcatgtttttgtttaatgactgattataattctattaccaaaaatatcacacataactaattatgtccttccagatataacatttatcatcaggtaagagtgaaatgagcaatacataatcacttcctatttctaaatatttttcctaatctttgacaaaaggcccatttcaatttggttcagcatcctttgagtgcctagcatgtgccagaataacaaaattagattagagacaataaatgcttgaaggaaatcagattatattttacgaaatgatagtaaatggaaaacttgaggggtttaaataactcagttaatatgttgcataatacatattcacaatgtgtctggtttatgttgttgttattgtttatccttataaatttttgtacaatatcactttttaaaataatataacttgtcaaaaaattactcctttatataggaacatcatagaagggatattatccttctaggagctacagttttgcaaattgttaatggcttgggttttgacttcagacacatggatttgaacctgatttcacgggtccttggacaagttactttattgcttctaaaccttgattttctaatctataaaattgtgataataatgcctaatttagaatcactgtgaggttagatgtaatcataagtataaaatactcaaaacttcctgacatggaggaagcagtcaatagatggtaactacaattatgagaacaaaaatggtaacctatcacatttatttgatggagccagaattagaattcctgcctttgcatactgtctcttaaatattttcattagctctcattaatgtcccaactgacatatttcatgataaatattctctcacatttctaattgcaaccaagtttaaaaggcgccaaaaggcataaaatcatctatctgccctgttatgtgacttcaatatatttcccaatacaatttcatgattcacccataaaaagttgtgggtcttcaaaatggaactgagtctgagatcccatttgactgatataataataaaaacaccttagatttttatagtaccttttatcacaaaaagctcaatgtacttttacatatttatcattgtaaccccaggaggtatagaaggacataaagtatttctcattttcagggggcataacagaggcattaggaatttaggtaacatttctaaggttcatagagatagttttcccggatgtcagtctttctgcaatctgttactctctctggcattaattatggctattgttactttagttaggctcaaacattagtgtttggcattaagtatagcttataattcagttaatcacttgatgaaatcaatgagtcaaatatataccatcacagtctaatcaaatgaaaatattttgattttatgttgagacacttttattattcaattttatatatgcatacattattcttatttatcattctgtgttaatttctaagggaagattttaaaggttattactcatttatggccttgaaaggaaccagttccaatctacttatcactcacctctccctaggctcattcttccatctccacttatatttttataggctattatctttattccatttacataggctaacagtattttctgctctagttttctatttagattgtgcttgaaaaatctatcaaaataaatatctaaaggaatatagaggtagactatataaagggctttttataatgtattgttttgaataaaacaaaatgtataactaatgtctacttgacattataaaacatagaatatcagaagaacactaaaacttgcttatggtttatagttttgcagttccctcctgggcttacattgctatgaattcatatagatggagctatagctgtggtctttcagtgagtaagtgaaatggaaggaaacaacattttgcagtctgataaaagaatgaaccttaaacttttagagatctaaattcattgtaggtaacaatagaaaacagacttaatgtttttatttcaagcttcaataggcgtctgtctgcatcttaaatgtatcatataatttgataaaattgacccactcaaggtcaagcccagtcatctgactgccagacttctatgagcaagtgtaattagcaccaagaagaaacacatatgcataaacacagaacagccagtgctgctgtttattgccatttcacactaacccctcttaactcttcatgttgatgtgattaaatacaaaatccatttctctgatggagcattatgtatgtgtattttaaggctgaagatactgtcgtaatagaaataatattttatacctttggtcattgtcattctagtatgagaaattagagaatatggttgcttgaaatgtcagtttttgtaaacatgagttggaagatgtcacataaatgaatggcattacagactgtttaagctgtatgagtaacaaatagacatttccttgaattattttcacacaatttactgtgaattttttcctgtagatgatatttctaggttccttgtgcaaacaataaaaaactttcttttatgtcagtgcttattatttaacttatagagtactgatgtattctagaatactaatatttctagatataaaatgaatgtgaagatacatgtgtctccatattagtcatatcaaaaggatacatgaaagtttgagcctctttgtaaggtttgtataaaagaggaaaatattcatatatattacagtgttcagtcctcgcttttaaaagatctttatataaatctcaattgggtgtgtgtgcatgcatgtgtgtgtgtgtgtttgtgtgggtgtggtttagagcaaataaaaggaggttgagaggtgaaaattacaggaatttgttggagtataccagcctgtctataatagaggaagtgggctacaaagcataggaaatcaggttggttgggtattgtggtaccacattatgctggctttgaaagccagtagagggaagtacagatatacaactattagaaacaggatacacctattgacaactgtgaattttagaaaatgccagacagaaagatacccaaaggtagaggaattagaaccaacacataagcagggttaagaagctttcgtcgaaaattcaagactccttgcaatgaggaggcagggtcagactataatatatatgaggacaagactgacaggtatagaagaagagttcatgacactgacaataatgaaagtgttttgatggccaaaatatttccatcagcactgggaaagagatagggctctcagcatataatgtttctgagccaatgagcccacggaagctgtgagggagagaaaccagagacaagagcctgtcaggctgctgctctgcgtagcccaggacgcctctaagatacctttgtgcctaagggagggctttaaaaacactgctgggaaagtacgcactgtggcactaagcaaagatctctagatgtggagcaaggaggcatgagtcctagtattatttatcccgctaactagctgattctcttcagaaagtcactctgactaaacttcatgattcccaggagaagactagattagtaataatagtgtatgctaggtggcattctaatcctctacatgcattaaatcagttaactctcacaagaatctcatcattttacagataaggaaactgaggaagttaagtaatttgcccaagataacacagctagaaattaaaagagctgggatttcgccctaaataggctgtttctagagcccaagtccttagccactatttattggagtacctttaaggtacttccagatgtacaattttgtaattttaaagaaatacaacagaaattacagatgacataacacttgcaagagaacaaaagcctctagaaaacagatattacgatgaacataaacagataaagctctacttttcatttcagaaataatcatactcttataccttgccgtgctctctactgctgacaaatagaagagagagaaaatttatagttggatgatttattcctttaaaaagattcaggtcaaatataataggattttgagaaatattttatataagatgtccttggctgttccaaccagcgggtaacattgttttgcagtttaattatttagcttttacatattttaagcagtctcctccataaacatatagtaaacagttataaagccattaaaaatagtgtttattatttaatgaaatgtgaagatatttatgaaatattattaagcatattaaacatcacataaaggatgtttactagaacattaaacaatggctattttgaggtaatgggagttggatttatagttacttttttttttacattttctgcattattgggtttgtaaaaattttgagcacgcattctttttcataagtcagaaaaacaggtagtttattgtttcagaaagaaaaaactctacagctcaagcttgagggcctatagccaccaggtgggaacaggtgctagatgctggatggtaaggaccagtgacctcttaaaagacaacttagataaagagagaggtcagaataataccccttgagcttttcagtttataaacaaaataatattcacttctaaaaaattgagatttaatacacatgaaaaatagatatgacaaaaatctcagaaattgctctaccatttttttagacaacaatatcaggtataactatcctgtccaattaaaattgcctaatattaattatatacaataacataaagtgtttccttcccttactgactatctgtattatggccaaggaatgttcttcttttcgatgaattaatcatttctttttccctattaaatcctttctcaaattgctcaagaatctcataaaatgaatcttcattcccagccagcaaaacccttaaagtgatttgcttatatttctatggcatataagtaagtgaaaaccataatacagtaaataattataatgagattgaacaaaaactggcttccggacaggtaccattagtgaattgctatttcagtgtcctaaacagtcacctgagttaattcaattttcatattctttaatttttgtctttaaaatcactattcagagaatggaaaactggctcaatgtctcaactgtgactgatggcagtctctgaacattcttacttattttgttttgctatttagaaatagtctaataccatgaccaagaatctaacaagagctatctaacaagtattatttatcttattagatttatgacattggtagaactggaaaagaaggtactaagaaaaaataccaaaataacagaaacttattttttaatatgatgtattttaatgtgttctgttatcttttaagttttataaaccacagacatatattaattttcagatatgaatgacgactgttttgaaaaaaaaaaacttatttgtcatatatagaggacataaagtgccgctgccctcactcatgcactcatttgactcatggcgcagtcctgaataattttaaaccaaacatgactgcggcaatcaattttcgtccaatttattgggcatgagttaaagccaattaaaaaaccatttttggtgcaattcaagaggaaaactgtataaacccatgaaaaacaaatttcagtcctagacatgagtcatcactattctaaatattggtgtcagtcccaaatcaacaagaacaaatcctaaaattgcacagtccacactggaaactgcatttatcagcaatgattttacacaattattaattttttataagaaactgacctgaaaggaaaatcatgctcttctgtctcatatctgaatcatttttgcaatgaaattaataggtagtttatagcagctccttgagtttctgaattaaaaactgaggtagaaagtcatctgtgacctttatataaagaaagcaaaacattttacctataattttaaagtatcttttacctattagaccatgtcttctttcacatgaatatagtggctctcttttaaggccataaaatgaaacaatccctgtatgctccagatattcttagggtaatcaaagcagcaaaattgaagcttctaggttggaaattacagctataaaatacagctatacattttcaatctgtatattaaaaaggcctttcaagttcagggttgtcttggttaaaagtattcacgcagacctgaattctggttctgcctctcctgtgtccttggtatatgactttgggcaagttgcccaacctctctaagcctcaactttctcattcttaaaatgggcattaaaaataacctaccttttagggctgttgtgagcattaagtgactaaagtatttgtcaagtgcctggcacagagtcaatcttcattagacgacagaactggataaaggaaagcccagtgattctcacacatggctgtgcaacacaatctacctgtgaggtttttttcttttcaagtacagatgcctcccctttacctcaagagatttcactgtaattctgaggtgtaatctaagcacatatgtgtatgaaaagctccacaggtgattctgatgaacaactgatttagagcaaaaatcagtacaggtttttcagtggtgcagttaacatggagttaaacagtggcttgagctattttggttccgttatctctgctgagcagattaattggactaattgccaattttatactttgtgttatactgaaaaagatttaactaggatatctttaaaagattttacttacattcatattgctatgaggtcacagaataagtgtgattttctacaacttcccgttagtaaaatgaaacaacatgtgagataaccccgggaaattgcagtcattccactggcatagatatattttagtgtttgttatgtttgttacttctatttaataaacataggcaaataagccaaaattacttaatcagttttttcagagttatattttccttttgagttagttcatttctaactgtcctacttcaagtatgcactctcctcaatgacagagatcaggtggtgccatgctgttaagaaaaaaaactatcagaaaaatatacacgttggactgacatgaccaccccacaagttactcaccatgattgtctaacagaaacacgtgcattttccctgagagtcaattttaaatattaacagaaatcaggactctccttaatatcttcccattagtggagattaatttattagatgaacaacctgttaccttgaaagggaaagagatatgtcctagtagatctggggtattagcaatgtcagtagaggtggcagcgtaagcctaggggaacaaaggacagccaggtcctaaaagtatcaagagaagatgatgaggaggtgaggaaaccaatcaagatagtttccaccatttgtgcctagggcaagtctgggtgcagctggtacattctcagacttacagcttttataggccttcttggtaggaaaccagagtgatttataccctggcatatctctatacaggaattcagagaaattccaatgctgctacaccaccagacagagtttttactttagagtttctagagaaactctctctctaggtttaagaattgttataccctctctctaggtttaagaatgcaaaccgcatagattacctaagggctcattgagacaatacttactctctgaggactccctaccctcggggtttagaaatgactctgcaatgtaaatataattcaacatcatgtattggcaagctgttggtagatcaaggagatgttgatcaagatgtcaatgagagagttggaatgcccagattctagtttttaaactttttgagaatcactatgtatctatgtataaagtgaatgatagtgtttgcttgttttactttgtagggttattgtaaagctaaaagaaaagtaaatctatgaacactggaaaattttctattggcatgagaaactagaggaaaataatttttaatgtatttaactttctagtaaattatacaaatgcctgtcaggaacatatttccttttttaaaattaagtaaactttttctttttcaatatgattctcgaaagtttcaaaatcaactcatcagataacaactctatgttaaaacttcaaaaagtgaaattgcctgacacttgctgaaatatcatggaacatgaaaatgaaaatctacagaaaatgcagaaccttccatttcgttttttgtttatgaatataatgttttatctaagtctcaccttagacaattggtttccaaaacgtggctctttgaaatttcagagaggagagagccccttcagagtttttcgtttaaccagcagagaattgcattctcacagctggaagctgaacagctgttgactctgacatttttctgttcccctgagtgagagttcaaggaccctctctgccatcaggaggacagccagtaaaggggtcagaaacatgttccagtgcaactcaactccaaggccaccctagaggactggagaacagataactcagagccactgttgcccaaatggtagagatagtctccctgttgcagaaaaccagcctccctgagaatctactttctgactcatggccagatctcaaggcttaagtgacctgaagcacccttgatactggccagtcttaggaatttggtgtccttttagaatttatcaatatatatctctttttttcatatatataggaaatttccttttcactcaaagtgcatttctgagtgcttcttagtggatactaaatagctaactccattttgattttataggaagaaaaacaaacaaaaagaatatttcagaatagctgtcactgcagcactatttattgtatccactagaggactcctctcagaataactcaaaatctctcccttctcattctctatggcctctggcatttgatgctcaactgactcttgagttgggccactggctacatatcagtgttagaatgaaaacattccccctactttaacacctcctgctagttcaataaagcgatgtttaaataactgaactggcttcaatgaactgtacttgccattttttcctgcttcttagctagataaaatggagataattaggaagtggatgagcaggtttaatgaaagccagtttcttttggtatactcctgaagcagcaatcatcatctgtttggcttttgaagagcaacaattataatcacttaaacccccaaggggaacaaaaatagaatttacattagcatataaaatatacagctggattgggcaagcctacaaaattctggggaaatcattctaatctgaatgctattcaaactcacaagtaaaatgagttcaagagtattttacatacttccttcctataaaataatacttataacaatgttgagaggattttcctaaaaatgaacacagggaaataaaaaattgttgccaggagagaatcccagagggaataagctaaactgtattgtcaagatatcacagagcaaaatgcataatgatattcacacaaagtactaatcactctgaagtgaagactttttacagtaaaactacacacatttaggagtttaagaaacaaattttgttctgatcactggtactacttactaataaggaaaatttcagattaatagtacttcccttctcctccattgcaaatgtgaaagtaatacaaaggaaagtgaaattgcttaaattgataatctattattataaaacagaactctgtttcctattttaaaatattttcatatcatttcctctcaaacaatctctttcttacacccccctttctaattgtagcccagatcacaggcaatctccctcatcatttacattatttaattacttctgcttttgtgtgcctttcacagtttacaagatacttttttttcttttttggtagagcacagaagaatgaaaatggggcctttgctttatccattatgctactagcaacaaaacactaacataatcaatatattaaaggctttcccggctgtgcacatttgtcaaaggcagtgtatctgagaaattacactaatgaatcttgaacaactcagcatcctacacagaaaacttgttctctctcatcataagtacatatcaatatgtaaagacaagaaaaatatatacttcatctttctatatattatttgaaaagccactgttacatttctttaaaatggaaaaaaagtcagtaagcaaaattccacctccactgagaagccttcctgaataccacactaaagtcaaccacaggcatattagcgatagcttcctctgtgctcctaaaagtactttttacatatctctgataccaattatctcactacgttataaccatctgttgacatctctatctcttacacagagtatgcattacttgacagcacagccattttttccagccaagtattatcaggttctagcacggtgcctaacccagtaagcatgtaatgatgtctgttgagtgaagtgtatcattcactgcattctaagacatcaaaatgttgtggtattcatggtaggaatcaaacatatattaatatcatctctgcaacaatatcagatttaatgataaattaagcactaagaaattagaaattcaaaagtctagatttctgtagcaatcttagctctaattatctttaacaaaggatcgtggtagtattttagattttgttaaatatttataatgttaatcagctctttaaactacctatcccatagttaattatttttactgaaaacacctaaaaagctgagttcttagttcttaatggtaatgacctcaggtttcattaactttataatctctatttttaaaaaattaaaagcattaacattgccttctcagcctttgtcaatgtctgtcaagcgaggcggtatgtagcttatattactctgccctttctataatgctctgagaggctttgaaaatctacaacagataactttactttgaacacaaaatgtgatgacttcatattcaaaaggatttacagggataattgtggtgcatagcttgaaggattccaggacctatgcaggaactttcttaagatcctttgtttttttcttactttaaacatagttcacatttttcctaccagttttccaagtgaaatgatcattttgtacagttatgacaaaacaataatggagaggtaaaagaaaatagactccagaatttatcctaaaatactcctggatttttagttagtaatagttaatattattatcattagataaaattatgttttgaggagttaattataccataaatttaaaactgaaacaactaataactttcccttttagcttcatattgctataaccataacttttatatgtataattacatatattcattatttatatagacagatttgtgcacttcaatgaatttgaatggaaagaaaaattgtatagacggttgtatgattttagtacataatcatgtaatataaatttccacatcaagggatgaaacagaaaattatataaacattttattagctactaaaaaaacttggcctgaattttatttaaaattagaccagtaactaaaattagttttgagaggggtaaaaattcaggggtttttccaaaatcaaagtgaaacagagttgagtggttgaatgctagaatactgtgggttgaaatgctcaagcctcataattctccccttaataacctggttcttaaaattccaaaattatctgacttaaaaaaaaaatctactagtactctcatagtaatgaggtttaaacatgattaatttcgatggtttcactttataaaaaattgaaacttacaaaatggatgtatcaatttttttaagttattcacttaacaagatcattaattcaaatactattttaatgtgtgagctctctgcatttaaaaaaaaagtaaggcaattttttaaaaaaaagatttacacaaaacaactcaggagaccatttattgcataaagtgcagatagagttattctgagtgctatcatttcttctcaggtgaaaagtgaaatattgagcagttttctgttgaatgtcaatgatgtccttaaacattttttcattgttacttaaagaggcttgaatgaattaccttgataaaatcttaacatctctactccacatctaagctaataaacccaagaataggcaatatttatgtcccaatctctcaagtccaaagattttataaacaaaaaagatcaaaattagagcattttgatgggaaaggatgttttctctgcatttattagagagtctatcatctttaatacttcaaaaggaatcatatagtagggccctatttaaaacttttaattttctatatcacttacaggtttctttagttcacaaaatgagggcagtttaaaaaatcccccttaatcactgtgattagaagttaattgattaagtatatcaaagtaaactctagcttagaaaatacatattatcgtaaaaaaatcaaatgatttgctacctataaaaatcatataacattttatgacattaccaaatgtaagtgtaatcaaaattttaaaagtcttgaaaatgaaaaattaaatcccattttagtcattaagatttttaaaatcactctgcttatttaagttcccttttaaggaaaattgggtacagttaggtcttcctcttatttagtaggtatttttgctatttattttaaaatacttttgtcactataactgagttaatttttctctccttttgtttttggaacagaattgagaatataataaattctccataattaatatcccaaaagagaaataaccagacaaaccaggctaatgtatccaaacccaatgtgggtacagttaaaaatatttcagtgaaacttttttcttcaaaaatgttgtattgcaaaagtgccaagattgacaggcaatccctaccctcagaatatgtggcaattacatgagctttatatgaaggccttttaaaatctagtatctttctattatttgattgtcattttgtttgattttggatccaattttggagtcagatagatttttgattcacatcctcactttatggttcataagctgtcttgccttaggtactcagtttctaggtgaaataaaagctaccacctaaagtgttttgaagattaactgagatactgcatataaggcacttacatatatgattaaatccatgactgagtcatagcaggtagacaatacatgttaactattaaaagttaacttctttgagattttagattgtatatttgacataggatacatactacatttaataccaattagaaacaataaatgaagattatttttgcatttttaaaactctaatgtcacttcagccattcttttttgcctttatgcttgcaggtacattgcatgccctggatatggtacaaaggacaaaacctgcaatgtacccattagataacctggctgccatccaccgccacttcctacatctcacttttctcttttatgcatgaatactttttcacttaaagtgagtcactgtcattggaatcaatgactttctatgagagtattgcttagttcacaaaacttaagaattttgtgcttatgaacattataagctttctgctatttgtaaaacttattctaataaactgaggttcaagaaaaatatcggaacatgaccactgtatttccaatgtgccaataacataaatagaacacttataattttggtataaaggcaattatactgaaaataaaaatgtttgtattttgtagaaaaaaattggtaagtgtacttttacattttaaatttgcacattaagaatatttagcaaacctaaaattggcacagaattatggtgagggaaagtatgaggaatatatagcattaaatatatagcattaaagagtttaaatattttaaaggcagttaaactacatgcactattaattatcatttagaagataattttcaattacccagcttattttaaataataatttttaatgaattacttcaactaaaacagtattttcagtgtttaggtaaaaactaagtaaatctgatggcttctttgagattatgactatgattaaaataactctgaataaagttgtttttctccacatgtcaaagtaatttaattttacatatatacaggacatatatttatttataaatatctatacctcagtagtagataatgaattatttctttgtttagcactgtatacatatagttcaaagtgtttattttaaaaccccaggtagtgttagtatagttcaggattaattataaatttaaatcctatgatagttgagtaatatgatctaaaattaattatatagttaagaacattgctagcttactacctgtggtctatggatattagtgggtagaagaaggagatttctcaactgaaattcttgctaatacaaagacataaaatactatattctaatctaaactcttcttttttcacaaatgttactaaattgattcctcttgtaccaacaaattagtagtttaaccattttggtgttttagctctcaaatgaaaactgttttaaggatggttattgcaaacagctagactaaaatcaatattgatgactttggaagctgactgcataaggtatcactttcctgtggtagttactgttgaactacagtaacttcatgtagaataggcaaaaaataagtcagttgttaaaaataagttattaaaatatatgcccgctaaaatacattaagctttattgcaatacaatcattttttaagttattttctgtgtttcctatgatcacaggaagtttataatttaaaaatctttatttcagaataggtcttgagaaatgtaggcacatgcaattatatctacacacatataaatgaaaattaagaatggactcaacaaaacaattcctttcagtgggtatttctgtttccatcccaaccttcaaatgagaaaacttagatggccttgcctcatcagaaaatgggcaggtccattccaatttagggcatcccagttctctccatggcaacagccctggataagctaaaaggcaactgaaagtttttaagactactgagcactattaatcctttttttaaaagtgcaaaacaggccaaacaatgtagaattctccagagcaaaggctgtcttttaccaaacttagaactgtttacattgtcacaaatactgtgttgatacctattcttggaaaatgaatgagaaaaaggggcaaaacccggaagtccatccatggaatatacctcctatttaaaaacaaaagggattaggaaaggatgctgaagaaggactcttaaatgaatgaatctgtaacactttaaaaagtgggatgaatgggaagagggaggagaggagagggcagtgggaaggagggttaataagcaattcctttctccagcctcaaaccttttaagaccacaactttgcaaatgtattatttcatcatcatttagtatttaaaatttgtctaagaatgatggcttcaaatgttgctacctgaggaagtgtgaggaagaatggtctaactgcaggagaggacacagagatagttgtagtagctgaggatgaccccattgtttcttttcttcttcaggattttgatcaggagtgacccggctaatgtgccgagttcaggaagtcagagctgcaaggttcttttgaaaccagacaataacgtagttcccttcgcctcccttccctgcacctctcccctgcttactgccaactcccacccactttaaatgcatcaagcctattaccatcccaagagtatcaaacatataaatacagaacttgtccactgaccatagtagagagaaaaacaaaattagcactactggtttgtacgggtttctttttgttgttgtttaacgaccccctcctcccagcccccaaccctttgtgtgtgaggattccccttcaaaccacccacagaccgagcagacgagaagaaatggtaattttcggtttaaaagttcacttaccacggcaacctcatattgctttgtcatgctttttgcacttaaattttcaaaactgcttgtgctgggcgcagaactgggaaggcagggctaaagtatctctagtaatcacaacaaaaaggagagaacattcaccaatcagaattacatttaaatatacaatcaaaccccagagcaagacgcacggttcagaacataccggggagggggtgggggtggaaaaagccaaactaacaaaacaaaaggtaaaggggagagttgagtggttggaggggaaattgatccaagccgccttttgaccgtggactggcttaaaaccaccaccaccaccaccccccccgcccccagcacccccgcgattacccgagtgactgcacttgcctccagccagctcaactgcaggagaggaaagccccatctaagttcactagccctgccacagtcttccactgcctgatgggttccttcaggaaaacacttccagaggcattcatccacttgaggtctggggttggctgctgctgcgaggctgctgcagccgaggctcccgcgagcagctgctaggatccttgccgtctcgttcctgcctctttcgagctgcacaatagccccggctgggtgcacctcattaagccagccgagagccccaggagcagggcaagccgtgtgacagcgctacctctttgtaatgactgtatgatggatgcaaccgaagggtggggtctgggtgggtcaacactgttaatgacagtatgtatcattctgtccgtcctccaggagaggggagggaagccccctgccctcccctcaggtcttgggctcgctttctctctctctctctctctctcgctctctctctctctctctctctctctctctccctctcttcctctccctctctctcctatctctcgtctctgtcccctgtcactcgcgcgcacacacacacacacgcacacacactttcctccctcttcccccacctccctatgccattttctgcagtcagcgttcaaaaaaagtacgaaaaccatcgggtaatttccaactgaaccgattacggacggcgaatttatccaaacacttaagcaaggagaggatcctaaaatcgaaaaacgaaggcggaaggggcgagaagaacggggtggagttgggtggcggagcgagtgggacgttaactggccaatagtttgcaactgccggtcaacacgcgcagcctactcagcgctgctccggaggcgcgggacgccgcctccacgtgagccgcgctcctcccagtgcccgggacggtgtcgggggcgggctgcacggcgagaagggcaaaataaaaccagcccgagaggccctggctggggttgagactgcaggagtaacttctgcaccgaggcagcgcgcagccagtcggggaagaactctgcaacctgaccgaaagaaagtccgaccctctcgggagggctgccaggatgctggagcgagtgtcagggtccgagactcccaagtcgggcgagggctcctgcccctggccattgggtacccccctccgaccaacacccccgtcccgcttcagagcgtcggccccacaggtgcgcagcgaagtcaccacgttggggactagcccccgcctctctctcttccctttctctcccgacccttcatcctcttcacttctcactccactctgagtcttgcctgtgctggccaggctgccccagggaggcaaaaaaagaaaagaaaatatctctcctttctccccctttaaggggagccttggatctttgtttcactaccacaccactgacaccatcccattgatatttttaccccctttcagttttgttaatggtcccaagaacccagttcccaggcaccggtttttcttctataggaaagccttacagaatgatttttattgccctgtgtggacaagtacacttattttacactcagcctcccgtttccaacttaactgtgatgctgtacactcttcatgtggctacaaagcaccttccagacatcctgagcgatttctctagaaccgtgcggatgctatttatttatatttattagagtttatggagcaccatttctctgactctgtgtaatagacttctatgtttttatcattgatgtcttatagcagctaagagaaagcaagaagcatagagaaaacagggtatttatggcaatgaagcatctctccatttttatgtcagccatttatttattaattagttaaaatttgtgtaggttgtgcagcctgctctacgccgtgggatagcactaaagattttatgccactcctcaaagagcttctgatccacggggaaggcaaaataaccttcagctcttaattgcttctaacaaaaaaccacttttaattgatgggaaggagagaccttgtcagaaagctttcagcaaagtaaaggaacactatggtgttgacctcagtggttctttcaggtcataaacctgcaaggcctcagaagtctccccttcattttttatttttattttttgttgaagcaattgctttccccccaccaccttttttttttttttgagacggattctcactgttgcccaggctggagtgcagtggcccgatctcggctcactgcaagctccgcctcccgggttcacaccattctcctgactcagcctcccgagtagctgagattataggtgcctgccaccatgcctggctaattttttatgtatttttagtggagatggggtttcactgtgttagccaggatggtctcaatctcctgacctttgtgatccaccggcctcggcctcccaaagtgctgttattgcaggcgtgagccaccgcactgggccgcttttcccacctttttacaattgtatgttttgaaggtagtaccagacttctgttcacatatttcctagaattaaatataaaggcaagggtagggggcaagagaaggccagtgggaattagtgagaaatctaaattaattgactaattaattaatttactaactgtaacaccaacgtaagcttgcctaaaagaagtcattagtgatataacttaatgagtaaaaataaaaattatagataattatatatgatgtataattgtataaaattagcaaaataattgtttttatgtaaatagttctttgtaagggcatctgaaaactgttcagacatttcctcttacattgttttagtaataaacttgcataatgaaaaagataagtataaaatagttgggagttgagaaagttaattgattttgtagtacgttattaattgtgatcataacaaaagtttattattaaagttctccatttctttaagacctagatgggcaagataccaaatacttttcttggaatacatcatcttgattgaaaactactaggatatttttgaaaaaatagctcattagctggctgggtaagtttgtttgtttacaatggacttttcaatgatggtggtaggcatcctggaagatagccactgtactaagttcatttttctctgttcttggctgctcctctaaccttgaactttatttagtcagggaaaatggaaggaatgggaatgctaactaatggaagaaagatattttctttgacctttgaaaaacagacttaagtaattgaaccataaatttagaaaccgggcttttaacaaatgaaaattttaagatgtataaaaacagctcccataagtatatgcaccaaatgtattaaccttgtgatatataagattgcacctaggaaaagttaacaccgttggagattattaagacttaccaactcattcagctttaataagcagaacttgagccaagtgcggaacacacttgtaccaaattggcaagaattatacacttaaatgtaaatacatttttttctgcgaggtaaagctattaagccccccaaaacaccttagatatattttttgaaaactgtcctgcaaaaatgtttgtcctaccaaaagtttctagcctatttcacaataacctatatgacagttagtacgacttggaaaagatgtttaatatctgaacaaggtaatatgttctatttcctatttttgttaatgggattgtagatgtgatgtatttcaggctctgtgttatctatggcaggaaaaaattgagggcaaaagagtttctttggcatacatcaagaactacattgtaatcaatacaagcaaaccaagtctggaaaatatataagcaaggtattaaataagtaattcactgtctataaatctcctaccagtgggtgaatgttgagagtcatataagggcttcagtgactaatggaatacagttgctcatcccaagcaaccttggctatccttttagaaacttctcaacaagttctgctgcatgtaagaacaagatcatgtctaagaatccagtaaggattttaaagattgtcttgcatgctacctttgaaaagcaagttcagtactcagtttttcagaaagcatttatttgcatgctgttaagatttctttacccaagttagacagtggagtttctaaagtcatatagaaattggttccgatgcttataaactgggtgacttgtacaattctcttaattactctggatcatacttccttctttagtaaaattaaaagaacaaggaccaactcctacagttgtgatgatttaatgatacaaagtgtaaaaacatgctgcctagtaaaatgtcagtcctattgaaacagacattgtaatttgcctcactcaacatgaattcttaacctccaccctccttgtcttactctaacttagagactggaaatttcaatatttcatttcccagttttctttgcatctagtagtggctgtttgacatagttatggcaaactaaatgtaaatacggctgggcgccgtggctcacgcctgtaatcccagcattttgggaggctgaggcaagcagatcacctgaggtcggaagttcaagaccagcctggccaacatggcaaaaacccatctctactaaaaaatacaaaaattaaccaggcacagtggcacatacctgtaatcccaactactcaggaggctgagacaggagaatcacctgaacccaggaggcagaggttgtagtgacccgagatcacgcctctgcaccccagcctggacgacagcatgagactctgtctcaaagaaagaaaaaatgtaaatacatattggctgagaaaccttctgaaaatgcttttgttttcctgatgaaagactaatagtgaccactgccacaactttttgccccatttgtcctacctgcttcttcctatgtggtatatgtgatttctggagctagagcagccatcttgcagttatgaaccacttgaagaccaatctctgaaagatggtgaaggaagataggaagaacccgggtttctgataggaaacttgacttgctcaattagtcctggactgttgacttttagacatcttgttgtatatgaaaaaataaactgctctttagttaagccatatttagctgaatgttctgaatattatgatactgaaatatctgccacgattgttgtggttttctgcttttaaataaaatctgccttgattatatgactctgaatgtcagccatgttgaagaatttcaggtaaaaaacttttctgagactccacccatgcacctatgactaggtcaccgttttgggtttggatgatctgctcaaagtattgaacctggagtgggtttgtaaggacctttttttttttttaaagtcccacaactgacaattctttttggggaagccccatcattgtactaaaagagacagaatctaacatttatattgtctaaataccttttctctttcctttcataatgtattgttgcttttgttttcaaataaacatactgggatgtgtttatttttgaatatgtttatattgaaatattcagaatattcactttggaaaacgataaatacttatttaattgatgatcctagtttgctgccatagctccacacatttttttttttaatacaaggtcttgctctgttgttcaaactagagtgcaacggtgcgatcatagctcactgtaactccagactcccagcctcaatctatcgtctattctcagcctcccaaactgctgggattataggcatgacccgacccaccatgagtggtttctacataatttaaaatgtcctctttaggagtcatgtttacaatgtgagtcacaattcaggagaatgtcagcaatgtgacaatagtatgttctctgaaggttggatttaatctaggaaaatacctaaaatgttgttcagaatcaaatcaagtaaattaagtgaggaatcacttaaaaactggataatacaggatttttcattgctgttacaaaaaaactaggtatatacacaaaataataagatctaaaacatgtctaaaatgtgttatagcaaggaaggcatccttcacataagcatctatcttcctaagggacagctttggaggcccacacacttggtcacatgtgttagctaaacacgtcagtctcatagctattttcagttgtaatttctttgaataagccagatgtttccttttcacctttccccttccattctgtcataaatttcttattctgaaacagactcagtgttcaattgattcaaagctatttttgtagtaccatcactttagttgattaaaaaaaaaatgtacaagtagcaagacagaacagtgccacggatacgatattaagactttgaatcaaactgaattttatttgagctccaaacttacttcttactagctgtgtgatttgagcggttatttaatcatttcagtctgttttttatctgtaaaatgaagataaaaatagtgtgtatcttagagagttgtcatgaatattaaataggataataaatatggggtttgtgtataatgctgtgtatgtagtaagtgattaataagcattacttatgataaaaccatgttaggcaaatagcaaggtctttgaaatacttaaaatgtaaagaatattagaccatttataggcgttgctaccagtaactgcaagtctaaaaataattcagctaattatgagttaatcatggatagttaacataggctgatccggatatttatctatcattttgtttgatgcagtagaaaaaatttggtcctttaaaataaataggcctaattccagtgtgtgataataggtaaatctctgcctatctaagtctcattttccacagtataatgtaactaaggaccgttttcccagggaaatgttcttaaaaaataggtaagaacctggtaattacttctctctctctctcttgctagtaaagaatagaaacccggatgtattttctaagaaccaggaaatcacaattaactttgagtttacaaaagatctccagagatatttcattacttggagaactaagatcagagtagaaggtagattactattgatttaggtcatatatgtttatgatgtatcaaccagatgattaaacaaaaaattagtattttggtgcaagttactcaactcctctgagcctgttacttcatctatgcaatgagtaagtagactatgaatgtagctttcagttgttcaattatttctagttaatttgtttctagttaattttaacaaaatataaaagacaattttctcatttgattcaacaataccttccccttactggcctaattgtattaatcatggagggggatagaatgtaggcatggggagagatgaaataaaatcattcagtggtttctgattgattagagttgattatgtgtttaaggtagaatattaaaaagaatatttttttcaggaaaaagggaaagtcaaagtcctctaaaaagtatttagatttttaaaatttcatattttactaggagagaaatatatcatgaataatatatgttaagctatgccagaaataaagttaacctagaaataaaattatgtatgttagtttttttctttttgtaagagacagggtctctgttgcccaggctggagtgcactggtgaaatcacagcccactatagctttgacttcctgggctcagctaatcctcccacctcagcctcccaagtagcatgccaccatacctggataattgtttttaatttttttgtagagaaatacaaaagtgctcatcctcctgcctcatcctcccaaagttctgggattacaggtgtgagccatggaacacagccttatatgttaaagtttaatttaatctttttacatacagtagaagagtctattgtagagcaatggttctcaaagtgtgatccacagctggcaccattgtcacctgggaaattgttagaaatgcacattactgggcttcatccaagacttactgaataagaaactcaggtggacccatcaacctatgttttatcaatagcaagaccttcaggttatactgatgcaagctaagatttgaaaaccactgctgtaggcttcagcaaaggagtacgtcttttgtaattgagattgcagtttctcccatccagagaaggagtctctatctgcattcctggaatctggcctcgttttgtaaagtgctttgaccaacagaatgttgtagtggtaatgacatgccagtctggaaccttggcctcaagagtccttcacttttcctctcccttggtaccctggtaccaccatgtaaatggtcctaaagtagcctggtaaaacatgagagatcatacggagaagagtccagttgtcctagctgcagccaaccaaaccagcctagagctagccaattcctaaacatgtgagacagcccagccaaatcaggagagctgacccataggcccatgagcaatagtaaatgtttattgatttaagccactggtgcagttgatattggaacctatatccttttggttccaaagtccctgttactactctcccacactgaggaactgggaggactataaatacctttcaatgtaaacctcttatttctcaggtaatgaaaccaaagaagtgtagtaataacttgtctaaactcatttacaatgtgaagttttcaatctttgtaatgccaaattctcacctctgattatgaaaatggagaccctgagcaacaatgtcagagttgttttgacctgggtagataattttcatttttaaatgagtgtaataggtgattctgctccagatgggtcataaattatcccggaatgtctaagtcaaattagttgtggagccagggctcaaaatctggtcttctgattcccagtgaggctagctttaaactacaccaatgatttcatcagggtaggtagatggattccctctggtgatgcaggattggcaggaggtggcatgtaacagaatcaccctaaggagctttttcaaaccaccccttcattgtccgagaacccctttcaaagtcccctcaaatgggaacccttgctatggtaaactactattactgatgggtttatgttatcttctccagccttcaggtattcaggggttaaaaacaagagcagtccggccaggtgtggtggctcacgcctgtaatcccagtactttgggaagcggaggcaggcagatcatgaggtcaggagatcgagaccatcctggctaacacggtgaaaccccatctctactaaaaatacaaaaaattagccgggcgtggtggcgggcccctgtagtcccagctactcgggaggctgaggcaagagaatggcgtgaacccaggaggcggagcttgcagtaagcggagatcgcgccactgcactccagcctgggcgacacagtgagattccgtctcaaacaaacagacaaaaaaccaagagcagcccaaggaaggttgagaagttacttctgtactgagtggtgcttcctcaatttgtttatctggataaatttactctcacccagtattatctaataaataaaggcttcagtgagaatgggactcagaagtattatgttttgacaacagtaattatataatgactagcttggatcctgcttatatagctttataccattccctaatggggcatttaactgcaaccctacatttagatgacacctatctctgggtaataacaatatatgaatctttatgttggaagttttcagcctagcattgactcagcctaaaggtttttctgctttgaccataattttctggtgtgcagtctcctgcctttttctccttttggtttgctaatgagtatttgattcgtgtacattaacctactggtatccccatgcacagatattattcatcacctgtcctacagctcaatactgcctttcagtttatctgatattaaaccaccatctatatgtctggatatctgctaattttttgctacaggatttacttgccagctgtgtttgtatctagtctgctcctcttcctttccccccgacatccttcccactcaccaggaaaaaagattgaaaccttccctggaatgttctatcctttggataatgaacctcttgccctcttgcatggtttctatgttcagacatcctgtctttattgtatactataggctgtctcattgtggctgtcacccacaccactgaggcctcagaaatgaatggcaacagatgggaaatgatggaaacatggccatgtgcatggtccttggaagacagggcaatgcaggtatcctgagggcagcggctttttcagttttggaattctatggctttttttttcttttttaaaattgcactttaagttctgggatacatgtgcagaacgtacaggtttgttacataggtatacacgtgccatggtggtttgctgcacccatcaacccatcatctgatttaggtatttctcctaatgctatccctcccctgacctcccaacccctgacaggccctggtgtgtgttgttcccctccctgtgtccatgtgttctcattgttcaactcccacttatgagtgagaacatgcgttgcttggttttctgttcctgtgttagtttgctgagaatgatgatttccagcttcatccatgtccctacaaaggacatgaactcatcctttttttatggctgcatagtattccatggtgtatatgtgccacattttctttatccagtctatcattgataggcatttgggtgggttccaagtctatgcttttgtgaatagtgctgcaataaacatttgtgtgcatgtgtctttctagtagaatgatttataatcctttgggtatatacccagtaatgggattgctgggtcaaatggtatttctggttctagatccttgaggaattgacacactgttgtccacaatggttgaactaatttacactctcaccaacactgtaaaagaattcctgtttctccacatcctctccagcatctgttgtttcctgactttttaatgattgtcatctaactggcatgagatggtatctcactgtggttttgatttgcatttctctaatgaccagcgataatgagctttttatcatgtgtttattggccgcataaatgtcttttgagaagtgtctgttcatatcctttgcccactttttgatggggttgtttttttcttgtgaatttgttgaagtgccttgtagattctggatattagccctttgtcagatggagagattgcaaaaattttctcccattctgtaggttgcctgttcactctgatgatagttgcttttgctgtgtggaagctctttagtttaattagatctcatttgtcaattttggcttttgttcccattgcttttggtgttttagtcatgaagcctttgcccatgcctatgttgtgaatggcattgcctaggttttcttctagggtttttatggttttaggtcttacatttaagtttttaatccatcttgagttaatttgtctgtaaggtgtaaggaaggagttcagtttttgttttctgcatatggctagccagttttcccgacaccatttattaaatatggaatcctttccccattgatggtttttgtcaggtttgtcaaagatcaactggttgtcgatgtgtggtgttatttctgaggactctgttctgttccactggtgtatatagctgttttggtaccagtatcatgctgttttggttactgtagccttgtagtatagcttgaagtcaggtagcatgatgcctccagctttgttctttttgcttagaattgtcatggctatatggctcttttttgattccatttgaaatttaaagtagttttttctaattctggggagaaagtcattggtagcttgatggggatagcattgaatctataaattattttgggcagtatggccattttcaccatattgattcttcctatccatgagcatggaatgttttttcatttctttgtgtcctttcttatttgcttgagcagtggtttgtagttctccttgaagaggtccatcacatcccttgtaagttttattcctaggtattgtattctctttgtagcaattgtgaatgggagttcactcatgatttggctctctgtttgtgtgttattggtgtataggaatgcttgtgatttttgcacattgattttgtgtcctgagaatttgctgaagttgtttatcagcttaaggagatttttggctgagatgatggggctttctaaatatacaatcacgtcatctgcatatagagacaatttgacttcctctcttcctatatgaatacgctttatttctttctcttgcctgattgccctggctagaacttcctatactttgttgaataggagtggtgagagagggcatccttgtcttgtgccggttttcaaagggaattcttccagtttttgcccattcagtaagatattggctgtgggtttgtcataaatagctcttattattttgagatacgttgtatcagtacctagtttattgagagtttttagcatgaagggttgttgaattttatcgaagaccttttctgcatctattgagataatcatgtggttttgtcgttggttctgtttatgtgatggattatgtttattgattttcatatgttgaaccagccttgcatcccagggatgaagcccacttgatcgtggtggataacctttttgatatgctgctggatttggtttgccagtattttttgaggatttttgcatcaatattcatcaaggatattggcctgaaattttctttttttgctgtgtctctgccaggctttggtatcagaatgacgctggcctcataaaatgagttagggaggagtccctctttttctgttgattggaatagtttcagaaggaatggtaccagctcctctttgtacctctgatagaattcagctgtgagtccgtctggtcctgggctgtttttggttggtaggctattaattactgcctcaatttcagaacttgttattgttctgttcagggatttgacttcttcctggcttagtcttgggaaggtgtgtatgtccaagaatttattcatttcttctagatttttgtagtttatttgcatagaggtgtttacagtattctctgatggtagtttgaacttctgtggaatcagtggtgatatcccctttatcactttttttattgtgtctatttgtttcatctctcctttcttcattagtctggctagcagtctatctattttgttaacctttccaaaaaatcagctcctggattcattgatttgttttttgaagggtttttcgtgtctctacctcctccatttctgctctgatcttagttacgtcttgtcttctgctagcttttgaatttgtttgctcttgcttttctagttctttcaattgtgatgttagggtgtcaattttagatctttcacactttctcctctgggaatttaatgctataaatttccctctaaacactgcattagctgtgtcccagagattccggtacattttgtctttgttgtcattggtttcaaagaacttattatttctgccttaatttctttatttatccagtagtcatttaggagcaggttgttctgtttccacatggttgtgcagttttgagtgagtttcataattctgagtgctaattcgattgcactgtggtctgagagactgtttgatatgatttccattgtttggcatttgctgaggagtgttttacttccaattatgcagtcaattttagaataagtgctatgtggtactgagaagaatgtatattctgtttatttggggtggagagttctgtagatgtctattaggtctactttgtccagagctgagttcaactcctgaatatccttgttaattttctgtctcgttgatctgtctaatattgacagtagggtgttaaagtctcccactattattgtgtgggagtctaagtctctttgtaggtctctaagaacttgctttatgaatctggttgctcctgtatttggttcatatatatttaggatagttagctcttcttgttgcatttatttctttaccattatgtaatgccctcctttgtcttttttgatctttgttaatttaaagtctgttttatcagagactaggattgcaacccctgctttttatttcctttccatttgcttgataaatactgctccatccttttattttaagcctatgtgtgtctttgcatgtgagataggtctcctgaatacagcatattgggtcctgactctttatccaattttccagtctgtgtgttttaattggggcatttagcacatttatatttaaggttaatattgttatgtgtgaatttgatcctgtcattatgatgcttgctggttactttgcctgttagttgatgcagttttttaatagtgttgatggtctttacaatttgtcacgtttttgcagtggctggaacaggtttttcctttccatatttagtgcttccttcaggagctcttgtaaggcaggcctggtggtgacaaaatctctcagcatttgcttgtctgtaaaggattttatttctcctttgcttatgaagattagtttggctggatatgaaattttgggttgaaaattcatttttttaagattgttgaatgttggcccccactcacttctggcttgtagggtttctgcagagagatccgccgttagtctgatgggcttcattttgtgggtaaccagacctttctttctggctgcccttaacattttttccttcatttcaaccttggtgaatctgacaattatgtgtcttggggttgctgttctcaaggagtatctttgtggtgttctctgtatttcctgaatttgaatgttggcctgttttgctgggttggggaaattctcctggataatatcctgaagagtgttttccaccttggttccattctccccatcactttcaggtacaccaatcaaacgcaggtttggtcttttcacatagtcccatatttcttggaggttttgttcattgtttttattcttttttctctaatcttgtcttcacgctttatttcattaacttaatctacagtctctgatatcctttcttccacttgatcgatttgcctattgatacttgggtatgcttcacgaagttctcatgctttctttttcagctccatcaggtcatttatgttcttctctaaactggttattctagttagcaattagtctaaccttttatcaaggtgcttagcttccttacattgggttataacaagctgctttagctcaaaggagtttgttattacccaccttctgaagcctatttctgtcagttcatcaaactcattctccatccagttttgttcccttcctggcaagaaattgtgatcctttggagaagaggcagtctggtttttggaattttcagcctttttgcactggtttttcctcatcttcgtgaatttatctacctttggtctttgatgttggtgacctttggatggggtttttgtgtggacgtccttttcgttgatgttgatgatatcactttctgtgggttttccttttaacagtcacgcccctctgctgtaggtctgctggagtttgctggaggtccacttcagaccccgtttgcctgggtatcaccagtggaggctgcagaacagcaaagattgctgcctgttccttcctcgggaagttttgtcccagaggggcacctgccagatgccagccagagttctcctatatgagttgtctgtcaacccctgctgggaggtgtctcccagtcagggggcatgggggtcagggacccacttgagggggcagtctctcccttagcagagctcaagtgctttgctgaaagatccgctgctctcttcagagctgcaggcaggaacatgtaagtctgctaaagttgcgtccacagccgcccgttcccccaggtgctctgtcccagggagatgggagttttatctgtaagcccctgactgaggctgctgcgtttctgtcagagataccctgcccagagaggaggaatctagagaggcagtctgactacagcagatttgcagagcggcggtgggctcagcccagtttcaacttcccagtgactttgtttacgctgtgaggggaaaactgcctactcaagccttagtaatggtggacacccttacccccatcaagctccagcatctccagtcaattttagactgctgtgctgggtaaacgaattttaagccagtggatcttagcttgctgggctccatgggggtgggatccgctgagctagaccacttggttccctgtattcagccccctctgcatggcagtgaagggttgtgtcattggcattccaggcaccactggggtatgaaaaaaaaactcctgcagctagctcagtgtctgcccaaacagccgcccaattttttccttgaaacccagtaccctgttggtgtaggcacctgagggaatctcctggtctgtgggttgtgaaggctatggggaaagtatagtatgtgggccagaatgcaccattcctcacggcacagtccctcatggcttcccatggctagccagttccctgaccccctgtgcttcacaggtgaggcaatgccccaccctgctttggcttaccctctgtgggctacactcactgtctaaccagtcccaatgagatgagccgggttcctcagttggaactgcagaaatcacctgccttctgcattgatatggctgggagctgcagactggaactattcctattcagccatcttgccatagaattctgtggtttctatgaagcaaagctacccagaaggagcagtaaggtgttgacagggaacaagtggcccaagacagcaactttaagtttttcctaagcgataccctgtatttatgcacatccagaaacatggtccaaggaggaacactgtgcctcgttttaacctttactgtattgtctattgctgatctaacaaactaccataaactttctggcttaaaacaatacaattcagcaacacaaagttttgaaggccagaaattcaaatttggtcttactaggctaagagtcttctgttaacaatagagaagaatctgtttccttgccttttccagcttctagagggcagtcgcattccttggcttctggccccttttcatcttcaacaccagaagtggcaggttgaatctttcttatattgcatcactctgacactgactctcctgccttcctcttgcacttataaggaccctcatggttaccttgagtctgcacagataattcaggataatctccctatctatagctgatctgattaactacaataattccatctacaaccttaattctcctatgccatataaaaatttacaaattctgagggttagaatgtggacatcttgtgtgggagcgttattcttccttccacatctatgtagtgaggaaacaaattctcatggtaaacatgtatttgtaaaaatatctattctctaggattcacaaagacaaaatacaaataaaaatgtgtcaggctctttgaccttagggaattcatataatgtagtgaaaattctaagtagattgaggagggaattactatgcagtagcctgtatgaatataccttttaaaaagtgtatgtggttctgtagttcatgttctgtatctattggttttcacgcttaatgtgtatgaggaaagcattaataaaaacccgacctccataccccaaatgaagaaatggtgatcaactcaaatgaaatgggtacaggtataaacacaaggaactgatcaaaagatgcctttatgaaaagtaaaagcaggtttttgcattcttattatcatgtaataatttttagtctcaaaccttcatcatttcctctggctccaaccctggataacatctatgctgctgatttagcagccaagtcagtaatttaagtactaggacttattctgcatgctaaattatgtttacagaatcaaaggattttcaaatggaagggcttatctggaatttggagatgagatctatccaagtgcagagaaaaatcttaagtctgagaaataattaaattacaacactgtttttattaagctcacaatcagtttgttgaaaaatgtctctctgattttatctttcttgttcatttttaaaacaaaaattactattgattttgtaaatataacacttgctcattataatgagttcaagtcatgcagaaaagtaaaaaggggtttaaaaaaatcactccaaatctgatttttttaccattattaacatataatacatgctatttttataaataagtattgaagtagaaagaagccaaatgaagctgaaatgaattggaatggaattctgtacttcaaataaatgttttatttagtacagaatgtagtattttctaagcgatccctctaaaagttaagaagagattattgaaaacattaaaatattgaaattatagctctaaaatttacatatgttaattgctatggcatcaattgttttcctgttctgaaagaaaaaagacattggccttttccttttcccctcttccacctcttgatcttgttatttataatatttatttatatattgccaaggtttacacatttatattctgttctataattatttaaatatattctcaatggatttgatgttcactcaagaccttttatgcatttcctcattttcttacctttcaggaatttcttaagtagctggatttcattatcaagtaatgtgtacttatctgatttttagtttggttggttttagtggagaagggtgcatgtttgcagacatctataagctctatctattgcagttttatatcttatatacatggatattttgtataccttgaaggtttgtgatgttgcattatatttcttttccttcaaaatttcttagatattttccagtggctactgttatgaatgttactgtgggatgatatgaaaccaattaatgacttatctcagggttgagagtttgtgtcaagtttccttggaatatatgttccttttcaatctgaagattagatttttgcttcgtttcagagaaagtttcttcattagttttgttttttaaattatctctttggatacattgatttgttcctctgtgtggttttgtttttttttaacctaagatacattgctgtgtggcacagaatttgtcagttttccagttctgtgagctttttgctggttgtttaatttcatcctttttttaaaaaaaaaaatctgtatttgctattactatctcaattcttccttgcttttgaaatttattattagttctttaatgatattgtttccatctcatatttccttaagtttgcaatccctcttttctccattcttctgtttttaaattcattaagcttcgtaaatgaaggagagttaaagtctttttcagacaaacaaatgctgacagaatttgccactaccaaaccagcatgacaagaaatgctaaagggagttctaaatcttgaaacaaaacctcaaaatacaccaaaatagaacctccttaaaatagaaatctcacaagatgtataaaacaataacacaatgaaaaaataaaacaaggtattcaggcaacaactagccagatgaatacaacattacctcacacctcaatactgatgttgaatgtaaatggcctaagtgttccacttaaaagatagagtggcagagtggataaatatctaccaaccaagtatctgcagtcttcaagagagtcacctagcacacatgggcttacataaacttatggtaatggggtggaaaaagatattccattcaaatggaaaccaaaagtgatcaggagtagctattcttatatcagacaaaacagactttaaagtaagaacagtttaaaaagacaaagagggacattatataatgatacaaggagtagtccaacaggaaaatgtcatagtcctaagtatatatgcacctaacagtggagttcccaaatttataaaacatttaccactggacctatgaaatgagatagatggcaacacgataatagtgggggacttcagtactccactgacagaactagacaagtcatcaagatcaaaacaatggacttatactatactataaaacaaattgacttaacagatatttacagaacattctacccaacaactgcagaaaatacattctattattttttgatttttaaattatggaacattcttcaagatagactatatgataaactacaaaacaagtctcaacaaattttaagaaaatcgaaattatatcaagtactctctcagaacacagtggaataaaattggaaatcaaagaatcatcaaaactatacaaatacatggaaattaaataatcgctcctgaatgatgttgggtcaacaatgaaatcaagttggaaatttaaaaattatttaaactgaatgataatagtgacacaacctatcaaaatctctgtgctacagcaaaaacagtgctaaaaggaaagttcataacattaaatgcctgcatgaaaaagtctgaaagaacacaaatagacaattgaagctcacacctcagggaactagagaaacgagaacaaaccaaaatgaaacgcagcagaagaaaagaaataacaaagagcagaagtaaatgaaattgaaacaaaaaaatacaaaaaacaaatgaatcaaatcttgttctttgaaaagaaaaacaaaattgataaagcattagcaagattaactaagaaaagaagatagaacatccaaagctcaattagaaaagaaatggaagatattacagccaataccacagaaatgtaaaagatcatttaaggccactatgagcacctttatgtacacaaactagaaaacctagaggagatggatacattcctggaaatatacaaacctcctagattaaaccaggaagaagtagaaattctgaatggactgataacaagaagtgtggttgaaacagtaataaaatattgccaacaacaaaaaaactccaggaccagatagattcacaacttaattttattagacattcaaagaagaattggtatcaaccctactgaaatgatttcaaaagataaagaaggaattctccctaaatcattctatgaagccattattatcctaataccaaaatctggaaagaatataacaaaatgaaaactaaagaacaatattcctgattaacagagatacaaaaatactcaataaaatactagttaactggatcaaacagcatatcaaaaagataatacacatgttcaagtgggtttcataccagggatgcagggttggtttaacatgggcaagtccataaatgtgatacaccacataaacagaattaaaaatgaaaatcatataatcgtctcgagacactgaaaaagcatttaacaaaatccagcatccctttttgattaaaaccctcagcaaaattggcataaaagggacatactttaaggtaataaaagccatctatgacaaacccacagccaacattatgctgaacagggaaaatttgaaagcaatcccctgagaattgaaagaagacagggatgttcacttttaccacttctagtcaacatagtactggaagtccgagccagagcaatcagacaagagaaagaaataaagggcatccaaattggtaatctatctatcactgttcaccaatgatatgataatttacctagaaaaccctaaagactcattgaaaaagcttctaggttggataaatgaattcattaaagtttcaggatacaaaatcaatgtacacaaatgaggagcactgctatacaccaacagcgaccaaactgagaatcaaataaagaactcaatttttatgagagctacaaaaaacaaaaacttagaaatatacctaatcaagaaggtgaaagatctctacaaagaaaactagataactgttgaaagaaattacagatgacacaaataaatggaaacacatctcatgctcataaatagaattaatattgtaaaattgcattaatgaagaattaacattgtgaaaatgccaaaagcaatctacaaattcagtacaattcccatcaaaatatgaccatcattcttcatagaactagaaataacaatcctaaaattcatatggatcccaaaaagagcatgcatagacaaagcaatagtaagaaaaaaacaaaaacaaaaacaaaaaaaaccactagaggtatcacattacctgacttcaaatatactacaagactatagtaaacaacatgataccggtataaaaacaggcacatagaacaacggaacacaatagagaaccagaaataaacccaaatacttacagccaactgatcttcaacaaaacatacaaaaacataaattggggaaaggacaccctattcaataaatagtgctgggaagtcacatgtggaagaatgaaactggatcctcatctctcaccttaaacaaaaatcaactcaagatggatcaaagacttaaatctaagacctgagtccataaaaattatagaagataacattggaaaaactcttctaggcattggcttaggcaaagatttcatggccaagcaaccaaaagcaaatgcaacaaaaacaaagataaatagatgggacttaaactaaaaaacatatgcactgcaaaatacataatcagtggagtaaacagacagcccacaaagtgggagcaaatctttgcaaactatgcattcaacaaaagactaatatccggaatctacagggaactaaaacaaatcagcaagaaaaattagaataatcccatcaaaagtggtctaaagacatgaacagacaattcccataagaagatatacaaatggccaacagacctatgaaaaaatgttcaacatcactaattatcagggaaattcaaatcaaaaccagaatgcaataccaccttactcctgcaagaatggccataatttaaaaatcaaataataatagatattggcatggatgtggtgaaaagggaacacttttacactgctggtgggaacataaactagtataactgctatggaaaatagtatagagattccttaaaagaactgaaagtacaactaccattgaatgcagcaatcccactcctggttatctacttagagaaaaagaagtcattatatgaaaaagacacatgcacacacgtttatagcagcataatttgcaattgtaaatatatggaaccagcctaagtgcccatcaccgaatgagtggataaagaaaatgtgatacacacacacacaccctagaatactaagccataaaaaggaacaaaataatgttttttgcatcaacctggatggagttggagacgattattttaagtgaagttaactcaggaatggataaccaaacatcatatgttctcacttataagtgggagctaagatacacaaaggcataataagtatataatggtctctggggactcagggggaagtttgtgagatggtgagggattaaaaaactatatattgtgttcagtgtacattgcttgagtgatgggtgtaccaaggtatcagagatcagcactgaataacttattcatgtaaccaaacagcacttgttcccgcaaaagctatggaaataaaaaaaaaaaaagaaagagtgcccatcccaaactagcaagattgcagagaggaattggcataccatatatgtactgctgatagtatcgacaatgttttattcttctataaagcaatttgtggtaaaagccaaaaaaaggtaattcatttattaaaagaatacggttgaatagttttagtattttctaagagttttcagccatcagaattttagaacattttaatcaccccattaaaaagcatatcagcaaccactccccttttttcttatctcacccccagcctaggcaacctgtactctattttctgtcactattgatatagccaagaaaaatttctacatgaatgtttatagcagcactatacataataatcaaagatagtccccttaagttttgccattgtacctgtttcttccttgagcttcaagaaggaacattcctcattcttttcctttatgtcagtgcagcatttctctccaaggaaattgcttcacaaaatcctccctctttgcatactctgagctatttttatatccttgatccagctgagacattcactagtcttgaaactggttccaaataggcaaagagaaggtagtataggttagcattttgagacatggattcaagaaataaacgagcccattcacattctgcctgatatggttagactttgttgtccccacccaaatctcatcttgaattgtaatccccatgtgtcaaaggtaggaggtgattggatcatgggggcagtttcctgcatgttgttctcatgttagtgagtgagttcttacaaaatctggtggttttataatgcagttttccctgctcttgttcccttctctctctcctgctgccttgtgaaaatgtgcttgcttccccttttaccatgattgtaagtttcctgaggtcttcccagctatgcagaactgtgagtcaattaaacctcttttctttataaatcacccagtctcaggcagttctttataacgatgtgagaatacactaatactccacctttgccagttacaagagaaattacttaagctttctgaaattccgttttctcttctgtaaaactgataatagcataatgttctcatagatttgtaacatttaaatgaatcaattcatgtaaagtgcttgtagtgataccaaatattcaaaaagtaaaatgtgttagtgattttatatttttaatttttgtgttgtgtaaaaagcacatatcataacagttaccatcttaaccatttttacatgtacagttcagtagtgtttacgtttatactgttgcaatataaatctctagaacttttttgtccctcagaactgaaacttcttaaaacaactataaccccatagtcccctttcctcagtacctgataatcaccattttacttttgacatctaggaatttgactactttggataattcatataaatggaatcatatttgtcctttttggatgccttatttaacttagcataatgttcttaagatttatccatattgtaccatgtaacagaatttcctgccttttaaagtctgcatagaattccattttatctttataccacattctgtttatccattaaactgtcaatggacatacgggttattttcacctcttggctattgtaaatagtgctgctataaacatggttgtgcaaatacctcttaaagtccttgctttcaaatttttggaatacatacccagaagtgggattgctagatcatcatatggttgttctatttgtaagttttttaagaatcatacttttttccgtagatgttgcaccatgttacaatctcaccaacagtgtacaagggttccgccttccctacatctctgctaataccggttattttctgtttttaaattgtagtcaccctaatgggtatgaggaaatacctcattgtggtttgatttgcatttctcttatgattagtgatgttgagcatcttttcttattggccatttgtacatcatctttggagaaatgtctccttaagtcttttgcccatttttattttttatttttaaattttatttcaatactttctggggtacaagaggtttttggttacatgggtaagttctttagtggtgatttctgagattttagtgcacccatcacctatacagtgtacactgtaccgaatatgtagtcttttatgtctcactacctcccaagcttcccccactacattccccaaagacaattatatcattcttatacctctgtgtcctcacagtttagctcccacttataagtgagagcatacaatatttggttttccattcctgagttacttcacttagaataatggcctccagctccatccaagtcgctgcaaaaaacattactttgtagatatatatctatagatatatatacacaccctgtgatatatatatcacaatttctttatccactcattgggtgatgggcacttaggttgttttcatatctttgcaattgtgaattgtgttgctataatcatgcatttgcatgtgtctgtttcatataatgacttctttttgtttgggtagatactcagtagtgggattgctggattgaatggtagttgtacttttagttctttaagaaatctccatactgttttccatagtggttgtactggtttacattcccaccagcagagtaaaagtgttcccttttcatcacatctatgccagcatctattgttttttgacttttaaattatggccattcttgcaggagtaaggtggtaccgcattgtggttttgatttgcatgtccctgataattagtgatgttgagcattttttcctaagtttgttggctgcttgtatagcttcttatggttaattgtctatttatgcccttagaccattttttgatgtgattgtttcttgctgatttgagttccttgcagattctgaatcttagtctttgcgggacgcatagtttgccaatattttcttgttatctgtttattgtcctgattattttgctgtgcagaagctttttagtttaattagctccatttatttctggttttgttgcatttacttttgggtttttggtcattaattctttgccttagcccatgtctggaagagtttttccagtattctagaaattttatggattcaggtcttagatttaagtctttgatctatcttgagttgatttttgtataaggtgagagatgaggatccagatacattctcctacacgtggcttgccagttttcccagcactgtttattgaatagggtgtcctttccccaatttatgttttgctttgttatttatgttatgctttgttgaagatcagttggctgtaagtatttgggtttatttctgggttcattgttatgttttattggtctatgtgcctatttttatagtagtaccttgctgttttggtaactataaccttgtagtataattttaagtcaggtaacgtgatgcctccagatatttttcattttgcttactattgctttgtctatgcatgttcttttggggttccatattaattttaggattcttttttccagttctgtgaagaatgataatggtattttgaagggaattgcattggatttatagattgcttttgacagtatggttatcttcacaatgttgattcttcccatccatgagcatcagatgtgttttcacttttttttttttttttgcagctgtagtaaaaaggattgagttcttgatttgattctcatcttggttgttgctggtgtatagcagtactcctgatttatgtacattgattttgtatcctgagactttattgaatttgtttatcagctctaggagctttttggatgagtctttagagttttctaggtatatgatcatatcattggcaaacagcaacaattttattttatacttcctgttttccagtttggatgccctttctttctttctcttgtctgattgctgcgatttgcccattttacaattaggttatttgatttcttattgctgcattgtagttctatatgaattctggatattaagaacttatgtaataactgatatatgatttgcaaatactttctcccattacatgggattttttttactttgttgattttttttgttgttgaacagaagttttaaagtttgatatagtgattatttttaaaatgtgctctgtaaattctatgtataacagtctatctttggaacttcatgtatgtctcaggagaaacttctaacttaatgccctgtaatatatgtatagttggttccttactgacaggcatttaagattttctaatattttgctatcaccaacatttcagtacttctctttacatgtgccatttttcatttgtatgacaacatctgtaggaaaaatacctagaggtagaattgcttaataaaatgatttatattttaaaatgttgacaacatatgtcaatttacattcctactgacaaattatgaaaatgcttattttctgacaaacagaaaaatataatacagtgtgtaagcaaacatcctgatttgccaaccaggtaaataaaaaattgtatcatattgttggaattgtatctcattttccttttcaattgcatttctcacattccaagggaaagtgaaatcatttcagaatttgagggccattttttttctataaagtgcttatatgtcttttgtctatttttggagattagctttctaaaaaattaaaaaatatttttttttctgtattaaagaaatcaactgattatagcatgagtggtaataatgttttctaaatgtgtttatctttgacttgttctaggctattgataattatttagaaaattttgagtttgttagttaatttacatattcttaacgaacctctttgtaaaaatcatacatagaaaggctttcctcactttaagatcttttatgaccttctgttttcacaatacatttttttatccaactagtatttacttcagtatgaagtatgcaacacagatccaaagctgtgttgtccaggtatgtatttgcacactacttatgaaagaagccaatcttcaccacccccctaccccaatgtttaatgctttctttatcatttgttgtgttaccatatatattttggtctattaatatttcattggtatatacatttttgaattatattcatatgtacacacccatatgcatacatatgttcatacaccaaaattctatactctctaaaaattctttttatcttattgaagtataattgataaataagaattgtatatattgaaggtatatcttttcttctttatatttagtatagtatactttaaaaaagttgacatatattatttgtacatatttatgtggtacatagtgatgtttcaatacatataatgtatagtgatcagatcaagataattactacatctatcatcttgaacatttatgatttatttgtattgggaacattcaatatccttcttttagttatttgaaactatacactatattattgttaactataattatcctacagtgctatagaaaacaagaacttattcctgtatctggatagaattttgtatcctttaacaaatctatccctattccctcctttccctgaccttcccaccctctaatatcctttgttctactttttacttctttaagataaacttttttaagctttcacatatgaatgaaaatatacagtgtttaattttctgttcctggtttattttactcaacataatgtctcccagttccattcatgttgctataaatgacaggattttgttcttttttatgactgaatagtatttcattgtgtatatataccatattttctttatccattcatctgctgtgggacaccaagggtgattccatatcttggctattgtgaatagtgctgcaataaacatgagggtggagatgtgtcttcgatatattgatttcctttcctttggataaatgcccagcagtggattgctggatcatatgatagttctatttgtagtttttttgaggcatctccatgctgtttcccataatggctgtactaatttacattccaaccgacagcgtactaacattctcctttctctgcattctcaccagcatttgttattttttgtctttttgataataaccccttaattggggtgagatgatatctcattgtggttttgatttgcatttttctgattattagtgatattgagtattttttcatatatttgttgcatttctccgacgattagtgatgttgagcactttttcatatatttgttggccatttttttatgtcttcttttatgaaatgtctattaagctaatttgcccgtttaaagtcagattttttttgttttttgcttttgaggtgtttgagttccttatatcttctagtttttaatcccttgtcagacagataatttggaaatattttctcccattctgtaaattgtgtcttccctctgttgattgtttcctttgctgtgcagaagcttttcagcttaatgtaatcccatttgtctatttttgctgctgtggcctgtccttttgaaatcttacacaaaaaatatgcccagaacaatgtcctgaggcatttcctcaaagaatttttctggtagtttcataatttcaggtcttacatttaagtctttaatccattttgatttggctttgtatacggcaaaagatagtggtctaggtgcattcttttgcatgtagatatcccattttcccaccaccatttattaaagagactattcttcacccaatatatgtcttggcacctttgttcaaaatgggttggctgtatatgtgtagattcatttctgggttcccttttctgttccattggtctctgtgtctgtttttatgctattacaatactattttgactactatagttttagagtatattttgaagtttggtagtgtgatatctgcagctttcttctttttgctcaggattgctttggttctttggagtcttctgtgattccatacaaatcttgggatttttttttctatttctgtaaagaatgttgttggtattttgatagggattacgttgaacctgtatatctctttggattttatggacattttaaaaatattaattcttccaatccatgagaatgaaatatctttccaatttttgtgtgttctcttcaatttctttcatcagtgttttatagttttcctcatagagatcttttactttattggctaaattgattcctaggtttttgctaggaattgattcctaggtctattgctcttgtaataaaagggattgatttcttgatttatttttccaattttttactattagcatatagaaatgctactgattttttgttgattttgtatcctgtaaatttaccaaattcactgatcaattctaagagttttttggtagagtcttcaagtttttctaaatataagatcatatcatctgtgagcaaggctaatttgactcatacctttccaatttgcatgccctttatttccttctcttgtctgactgctctggctgggacttccaggattttgttgaataaaagtggtgaacgtgggcatccttgtcttgttccagatcttagacaaaagactttcaattatttttccatttagtattctgttagttgtggttttgttgtatatggcctttattgttttgaggtctgtttcttgtttgctttgtttgtttgtttttgtgtatgcatgtgtattagtccattctcacacttctaataaagacataccacagatggggtaatttacaaagaaaaagaggtttaatgaactcacatttccatatggctggggaggcctcacaatcattgcagaaggcaaaggaggagcagggcatgtcttacatggcagcaggcaagagagcatgtgcagggaactgctctttataaaaccatcaagtctgatgacatttattcactaccatgagaatagcataggaaaagcccaccccatgatttaattacctcccattgggtccccctgatgacacttggggattatgggagctgcagttcaagttgagatttggttggggacacggccaatccatatcattccactcctggctcctcccaaatcatttttgtcctcacatttcaaaaccaatcatgccttcctgcagttccctaaagtcttaactcatttcagcattaagtcaaaagtccacagtccaaagtctcatctgagacaaggcaagccccttccacccatgagcctgtaaaatcaaaagcaagttagttacttcctagatacaatgggggtgcaggcatcaggtaaatacagccattccaaatgggagagactggccaaaaaaggggctacaggatccatgcaagtctgaaatccagtagggcagttattaaaccttaaacttccaaaatgatctcctttgactccatgtctcacgtccaggtcacgatgatgcaagaagtgggcccctatggccttgggcagctctgtcccgttggctttgcatggtatatcccccatcccagctgctttcatgggttgatgttgagtgtttgcagcttttccaggtgcgcagtgcgagatgttgatggatctaacattctggggtctggaggatgatggccctcttctcacagctccactaggaagtgccccagtggggactctgtggcagctccaaccccacatttcacttctgcactgtcctagcagaggttctctatgagggccccacccctgcagcaaacttctgcctggacatctaggcatttctatccatcctctgaaatctagccagaagttcccaaacctcaattcatgacttctgtgcacctgcaggctcaatatcacattgaagctgccaaggtttggggcttgcatcctctgaagccatggcctgagctgtaccttgccaccttttagccatggctggagcagctgggatgcagggcaccaagtccctaggctgcacatagcaggggggccctggacctggtccgggaaaccattttttcccttctaggcctctgggcctatgatgggaggggctgccatgaaggtctctgacatgtcctggagaaattttccccattgtcttggtgattaacattcaactccttgttacttatgaaaatttctgcagcaggcttgaatttcttcccagaaaatgggtttttattttctattgcattgtcaggctgcaaattttcacaacttttatgctctacttcctcttgaatgctttgatgcttaggaatttcttctgccaaataccctaaatcatcattctcaagttcaaagtttcacagatctctagtgcaggggcaaaatgccaccagtctctttgcatagcaagagtgacctttactccagttcccaacaagtttcttatctttatctgagaccacctcagcctggatcttattgtccatatcactatatgcatattaatcaaagccattcagcaggaccctaggaagttccaaactttcctacatcttcctgtcttctgagccctccaagtctctgggaagttccaaactttcccacattttaatcttctgagccctccaaactgttccaatctctgcctgttacccagttccaaaatcgcttccacatttttgggtatctttacagcagcactccactacccagtaccaatttactgtattagttcgttctcacaccgctgataaagatatacccgaggctgggtaatttataaagaaaaagaggttttctttttccttttttttaaaccaatgagtttaatatcttcggatgtttccttgttacattttagtgtccatttctttaagtttaaagaatgcccttgtaattttttgtaagacaagcctggtattggggaatttcctcagcttttgtttgtcttggagactctttatttcttcttcatgtttaaaggttagctttgctaggtgtagtattcttggtgagtagttctttcttttttccccttggctttgaatatagcatcccactgtctcctggcctgcagggtttctgctgagaaacctgctgaaagccatatttgggtgtcattgaatgtgatatatttctttttctactgcttgagtaatccctctttgtgtttgatttttgctaatttgattatgattgtttttcttgaagatttcttctttggattgaatttgattgatgatatccaagcttcctatacctgaatgggggtgttgttttccagatttgggaaattttcagccattattttcttaaatatttttctctctcctgtcctttgaaatttactattatgcagatgttagtttgcttaatgtagtctcacatttgatgtgtcatcttgactgtcccaagggatgtccaggtagcttgaaaacattatttctgtgtgtatgtgtgggtgttttcagaagaaattagcatttaaattgaagtgagtaagatcgacttcgcaaacatgggtgggcatcatccattttattgaaagcccatataggtcaaaaggtggaggaagggcaaatttcttatctcttctatagctaagacatccatcttctcttgccctaaaccatcagcatttctgattttgaagcctttgtccttgtactgggtcttacactattggcttctctgtgtctcaggtctctgtgatttaactggattacaccaccagctttccttagcctccagtctacagacagcagattatggaattttttagcttccataattgcatgaaccaatccctcataaaaaatctctttccctttctctctatatatcctataggttctgtttctctagagaattttgattaatgcaggagtttattccatttacatttaactaattattatttataaggacagatttactaatttgttgactgttttgtttttcttctaattcttttatccctctttttctctcttgctgtcatagtgtatgttctgccttttttttttttttgagacagggtctcactctgtcatcctggctggagcgcagcattggcatgatcatgctcactgcagccttcaagatctgggctcaagtaattctcttgcctcagcctccaaggcagctaggacaacaggcatgtgccaccacacctggttaatttttaattttaatttttatagagacagagtattaccatgttttgcaggctggtctcaaactcctggtttcaagtgttcctcccacctttgtgtcccaaagtggtggaattacaggtgtgagccactgtgcccagctgttgttttatttttctcttacttgataggctttgattcgtgtctctcttttcttttctgtaacttttatagatattttctttggtatgcttacacaaaatatattatagttttggctggctgtggtgctttacacctgtaatctcagcattttgggaagccaaagtgggaggagtgcatgaggctaagagtttgatacatccatctctacagaaaagaaaagtaagccagtgtaacgtagtgagaccttgtctacacaaatatatatatatatattagatatatatatatatatatattttaaaaatagctgatcatgatcatgtgtggctgttttattagctgcttgggaggctgaagaataattgcttgactccaggaatttgaggctgcagtgacctatgatgatgccattgatgctaccatattacagcctgggtgacagagcaagaacccatctctattaaaatatttacataggccgggtgctgtggctcatgcctataatcccagcgctttgggaggccaaggtgggtggatcacttgtggtcaggagtttgagtacagcctggccaacatggtaaaacccgatctctactaataatacaaaaattagccaggcatggtggtactcgcctgtgatcccagctactcaggaggctaaagttggagaattgcttgaacctgggaggcagaggtcgcagtgagccaagatcatgccactgcactctagactaggcaacacagcaaagctccatctcccccacccccgcaaaaatatatatacatatatatatttgtatatataatggttttactgtgtattttaagacattaacaactcagcatcatttgcatataaaaactgtacatttttgcctcttcaccttgatggctcattgtgtactattaatgtcacaatttacgtctatttatattgtgtatccattcatataatttagttatagttatttttaatatttttttaatttttatgctattattaaaagtgtttttccatcaccattacgatgatataatattctgattttgcctatagatttatctttaccaatgagttttatactatcctatgatctcatgctgccacttagtgtcctttcactttaatttgaagaacatcttttagcatttcttgtaaggcaggtcttgtgatgaactcccccagcttttgtttgcctggaaaaatctttatgtctccttcgtttctaaagagagttttgctaagtatggcatttttagttggcagattttttttttctttcagcacttaagtatatcatcttattcccttctgttctgcaaggtttctgctgaaaattctgctagtagttttacaaagattctcctatacatgtcatttttttcttgatgctttcaaaattttctttgtctttaatttttgacaatttgattatgatttgtctctgcttgggtcattttaggttcatctgacttgatgttctttatgtttcctggatttggatgtctatttctttctctgggtttgggatgttttcagccaatatttctttgaataattgttttcccctttctctttgtcttctccttcaggaactcccatactatgtacagtagcctgctttcttgtatcctttaaggtccttaagctatcttcactcctttttattcttttctctttttgcttctgtcagtcagtgatttccaataacctgtgttttagtttgctgatccttccttctgcatcatctaatgttcttttgaaacctctgtattgaatttttcagtttggttattgtatccttcagctgtatgatttttgtttggtactttaaattattttctgtctctttgttgaaattctcactgtgttaaacccttgctctcctagccttggcaagcctctttatgagaatttaaaaaaattctccatcagattaatcatacacctctatttcattagagttggtttctgtagatttattttaacttttatttgaaggatgtttccttgtttttttcattttctttgactctcatgttggcttctgggtattagataaatcagccacctttctcagtgtattagtccattctttcactgccgtaaagaagttcctgagactgggtaatttataaagaaaagaggtttaattggctcatggttctaccgactgtagagaaaaattagcagtttctgtttctggagagatctcaagaagtttccaatcatgagggaaagcaaagggagagcaaggtgtctcatatgtcaggagcaggagcaagagtaattgaagggggaggtgcttcatacttttaaacagcctgctttcatgagaactcactatcatgagaacagcatcaagggtatggtgctttaccattcaggagaaatccaccccaacgatgcaaccacctcccaccagttcccacctccaatattggggactacaatttgacaggagatcttttgggggacagatatccaaaccacatcactgcatcttcacatactggcctaataggggagatgaccctcttcagcctgaccagagatgctcagtacttactgaagctttttgctctcccaaacccacgatatttgttcttatcaacccccaggaaactagagcatgctatgtcctgtcagtggcctaaaacagatgagttgcaagccacactgtcaggcagcagttggaaaagttaaggtggggagaggccagatgggtagtatttcaaatctttctaagtagaagctgaagacttctgttttattgttggagcaatccagggggatgagccacagagtgcttacatactcattcacactcttaagaggattagcgattgccttccctatagctactaaagataaagacaggctagttagaaaccaactttgggcagcagccagaaaagttaatacattagatgtgtagtctaatttctttgaggaagaagctgggagctggaatttattgtctatttgctctgcattgagccaggaggaagtgctacaagaagtgttcgtgcatccattctaaactacctcttttttctttgttggttgaggggactaatgaatgctaggctgctaggtcacagagacaggtgagttaggaaccagttgctcaggcctcagctggaaaagttggggcacgagatgtgacttgcaaactcattcctcttcagttggaatttagtagttccctcctaattgtatggcactgtgctatggatggggtttatggcaagagtgtgactcagcttttcccatctgttttgatatcactgtcctctcagtcaccccatgtgcaggagtctctcaattagtttctgtatatttcacagaggaaattgatctatgtgtactgtttattcaatatgtctgtaggttgagggaaagtatgaagccacgtattctgccaccttgatgatgtctctctctctctctctctcattctaatttaactattgtagtttttcaatgtcgtaatacctggaattggaaacattctctactcctacttcagtacctttatttttcagaatttcctggctactcttttttgattatttttatatgaaatttagaagcagcttctgaaattcaaaaaatattgtctaactatttttattgggataaagttaaaatttaaaaattaaagaatattaaactatttacaaactttaatttttctttccagggacatgatatgtctttctacataattgcctcctgttttgtatccatcagtggcattttaaggttttactcatatcaagctaatatattttgtattatatttattcctgatatttgttattattttaaattgttattttaaattggatattttttcattacatctgctaaactgttgtttgaatatataaagcctatttatttgtatattagtattatactggttgtcttgctggtgtctgaaatagctttttagctgattctcttgcattttctagataaacaattttagtatctactaataatgataatctattttttccattccaatttttatagtgcttactctttctgataatgtgtttgcattggctaatgtcttcacaataatgattcccctccatatgttgccatgatttgctctcttacttgctttaagtctctacccaaatgttatcttaacagagacgatactcccgatcactgtatataaaataacgatgttacaccctttactccaatttatctcattccatctctattaccctgctttatttttcgtccatagctgtttttcccatctagtatttgtttatgtatttattggttttttcttaatactgtagtctctatgaatgtggggtaattgtttttatacaaagatttgtcttctctgactaacatgatggttagcaccagttggttctaaataaatatttggtgaatgaatgcctgagtgttaaacaataatggtggtaaagaatatcttttacttattcctggattaatgggaatgtgtctgttgtttctctattgagtccaacgctagtagttcatatttaatgtttatataaaacatattttctttaatctcagtaaaaaattctcaaaattgaccttcattttaaattcactggtttattttttaaattaaacttttttttttcctggcatttagtcccacttacccacgttcacagactgatattagtatgtgagccttaaaaatttgataattgaagtttgcggtttggctttgagtcttactagtatatcattgctttgtgagcttaaccttttttatcaatacttttttgttttgctccattttgaatgtaacacatgtaaagagaagtgcacaaggtataaatgtatagctcaatgactgaacacaaaacaaaactcataaaaccactgtccaggtcaaaaaaatagagcactgccaaaatgctaccagtatggattatatcccttcccaatcattactgcctctgcacactgtcttgatttccaatgctgtaatttagttatatttgttttagaactttatagaaataaaaccatacaatatgtatttttgcactgtgttcttttactcaagatgatgcaattctttataaaatttattcatgtttttacttattgctctagtttcttcatttttatggttgtattacgatattgcatcgtgggaataggctacttccagaattaccaaacccctctccctacaccttcaacagggataattcttacttgctgttagttcctttttcctttccccttagagagttttctggctttttccccctgttcactctaattattgcttcttacttttcttttattattaacttttcaaggcccgtttaaaatatccttagcctttctgctcttaatcaccctgtccttgttccattttcttctccacaaatcccgccacctcactcagaaaaattgaacacataatattatgaagaaggagaaatcacagcaatcacagtctaaagtagtatataaataaactgttaattttcatttttttaatttactgagaattttttcacaggaatatcttagatttaaaatggtgtttgtttttctatgactttatttttgagtgacacgggttagctctttttagcttcattcttctaagtttgctcaccaaagttgtgtgtttggttttttttgagaaggagtctcactcttttggccataatggagtgcagtggtgcaatctcatctcattgcagcctccgccttccgggttcaagcaagtctcctgcctctgcctcctgagtagctgggattacaggtgtgtgccactatgtctgcctaatttttatattttttagtaaagatggggtttctctatgttggccaggctggtcttgaactcctggcctcaagttttatcctgcctcagcctcccaaagttctgggattacagatctgagccactgtgccctgcccccaccatagtttttaataaaaatatttctgatgatttaggagaattaaaagcaatttagaaagtaaaactatcttacttagatatgtataattagatatttaaagctttgagtcacataagttattcctctaggggcatatcttattttttcattgatgcttaaactgaaaataaataactcaaaatacatttgttactatgagagtggcactaacttcaaatattatctcaaattttctgatcaattttaatattgctctcttttagcagcaggaataacttgaagtgttaatctaaatttagatattaacaatacttatctacaacaaacattttaattaacctacttattctactaatagcatcactcaattttgctttaaaaatgagagttctctctgacaaaaatttgctggagtaattttctgtagcaaatggatagaaaactgctagccctatttggttggtgccaggttttgaagtaatttaattggggttgttcttaagtttaacctgtcaataatatgcagggaagattctctagtatctcaaataaacaaagataagaaaatcagtcctctcttaaatagcaaatggactctcagagcaatagcatttacattaatctacaacttagttataaagtgtgtttcaaaaacaaatagaaacaaagttattcaccatctgcacacctgaagaatattcaaaagtaaatgacaaagcaatattttttataatactatattttgaaatgagaaaacaaactgcttttcgggaaggagagttgatctttgatttttttttaaattctataatattttatttcttcattttgctttgttttgttggtattttttcttatatataatagttgtgcgtattttttgggtacatgtgatatttcaacacatgtatacaatgtaaaatgactagattagggtaattggggtatccatcacctcaaacgtttattctttgtgttgaacatattacaattcttctcttctagctattttgaaatatacaataaattattgttaaatataaattccctactgttctattgaatactagaacctaatctatctgtgtaaatgtactcttatacctatgaaccaaatcagtcttttatttatttttattttcttttaattttttgaattggagttttgttctgttgctcaggctggagtgcagtggtgcgatctcagctcactgcaacctccgcctctcaggttcattcgactttcctgcctcagcttccctagctgggattataggcacccaccaccacgcctggctaatttttatatatttagcagagacagggtttcaccatgttggccaggctgatcttgaactcctgacctcaggtgatccacccctccatggcctcccaaactgctgggattataggcgtgagccacagtacccagcctaaattagtcttttagatgtcactactattggttgatttattttgatgttacaacacagataaaataacttgaaaatttctttcttattgagtcataacataaatctataaactaaattaattctttaaaaagatatatataatttaaattattaacttaaaaattataaacagttatttttccttttgctcatcataaaacaaaataatttttcagtgtgcactaaagtgttttaattgtgtgtataaatctatgcttttatacaaatacatatatgtaaatgtaagtatttcgtaggaaaactagctgtgaaatgtttcacgtgcaaaaattaaacactatacatattctagttaaatctctttggagtggataaatcacaagacgcctttctttttttctttctttctttttttttttttgaggtggaatcttgctctatcgcccagtctggagtgcagtggcgcaatcttggctcactgcaagctctgccacaagaggcctttcttaatacagctattgaggtgagaaattttgagaagctttcatttaaataaacccattgaaagcatatttgtctgtgtactctcctaagattacattaaaatcatagacaagaatttagagataaaaattcacaaggaaaaatagaatgagagggagacaacttatttattaatgttgcaattgttattttgggcatttttgttttaaatttagagttgccatacttagtgagactgggagacaagcattatttttggatgaatttaagcggttggaactacctgcaaaatggaataagcttccacctaacacatagtttccttttcccgttattcctcagcaattaatcagagatggaatcttcacttatgcaaatgctgtttacagggcattcgattagtatttgtgtttgtgtgtgtatgttatggagcatggattggagctgggggttttgagggaccagatgatgttgtacctttttatcccattgagtatctgtgattcaaaaactttacaacccctttcttatttacaaacctagtatattctgtggtgttattattttaaaaatctgaactatcatctttatgataattaatagcaactaggaaatttaagaaaaattttgagtaactactattttttatttattattttgtctcttatagaagcagtacaatttgatgattgtttcaaatgaaaacaagacactttcaattaacttacataggtacttgaattgtgttggatttagtgctgcagctttcagtttactagcaaatgcttgtgctgtacttttatttttttattttactttttgcaatttttttttattatactttaagttctagggtacatgtgcacaacgtgcaggtttgttacatatgtatacacgtgccatgttggtgtgccgcacccattaacttgtcatttacattaggtatatctctaatgctatcccttccccctccccccacctcacaacaggccctagtgtgtgatgctccccttcctgtgtccatgtgttctcattgttcaattcctacctgtgagtgagaacatgtggtgtttggttttctgtccttgtgacagtttgctgagaatgatggtttccagcttcatccatgtccctacaaaggacacgaactcatcattttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatatacccagtaatgggacggctgggtcaaatggtatttctagttctagatccctgaggaattgccacactgtgttccacaatggttgaactagtttacagtcccaccaacagtgtaaaagtgtttctatttctccacatcctctctagcacctgttgtttcctgactttttaatgatcaccattctaactggtgtgagatggtatctcattgtggttttgatttgcatttctctgatggccagtgatgatgaacattttttcatgtgtcttttggctgcataaatgtcttcttttgagaagtgtctgttcatatccttcacccactttttgatggggtttttttttttttcttgtaaatttgtttgagttcattgtagattctggatattagccctttgtcagatgagtagattgcaaaaattttctcccattctgtagttgcgtgttcactctgatgggagtttcttttgctgtgtggaagctctttagtttaattagatcccatttgtctattttggcttttgttgccattgcttttggtgttttagacatgaggtccttgctcatgcctatgtcctgaatggtattgcctaggttttcttctagggtttttatggttttaggtctaacatttaagtctttaagccatcttgaattaatttttgtataaggtgtaagcaaggcatccaattttagatttctacgtatggctagccagttttcccagcaccatttattaaatagggaatcctttccccatttcttgtttttgtcaggtttgtcaaagatgagatggttgtagatgtgtggtattacttctgagggctctgttgagttccattggtctatatctctgttttggtaccagtaccatgctgttttggttactgtagccttgtagtatagttcgaggtcaggtagcatgatgcctccagctttgttcttttggcttaggattatcttggcaatgcgggctcttttttgattccatatgaactttaaagtagttttttcctattctgtgaagaaagtcattggtagcttgatggggatggcattgaatctataaattacctagggtagtatggccattttcacgatattgattctttctgtccatgagcatgaaatgttcttccatttgtttgtgtcctcttttatttcgttgagcagtggtttgtagttctccttgaagagatgtgctctacttttaaacagaaggcacaaaataaaaaagaaaaagtcagtattttaaaagctagaaaattaactagggtgattttctgtttagagttggttaaacctagtttgaatcccaagtttgctattttccagttgtattaccgttagcacattgtttatccttttttcagtctcaggttctttttctgtaaaacgaagaaatgaagtagaagtagaatctactgaagggcttttatgaatatttaatgagattaagcatgtgaaggatttaccacattgccttgtaaatgcttaattatcattggccattaataataggatgatgttaacattgtagacagtcagccccatgcataacagatgtgacctatgataagtcatataacataccttaataaaggtctagagctaagaaccatccggaaaatctcattcaatagactttccatggaattctgtaaaaacgtgggtaacaatcagtttctcacttttcccaggaaaatgccaaatagattaaacatgtaaagataatgtttcctattttgacattgtcctagagaggctaggtaagaggcagtgtctgttctagaaaacctgtttttctatatccattcagttatgtaagtagctattgttagtttacatcactgtgcaggggtttggctggcataacaagatgctgaagtgttttaaatgcatgagcctggtattcctgtgtgactaagtgcattgtttactaatgacattaagtgtagggtagctcatttaaaaattggtgtattgtataaaatgaacccgatttaaaataagaccatgtattttatttaatccaaaaattaatgttcctgaagaaaatgcaaaccaattttaacagttactatgtaattctgataaaaatatctggcaaaaatgatcagcaattacttactgttaagcctattctacttgtactgaatggagagagatttaaaaaaattttaatttaaggaatatgtaatagtaggagcccagaatcataatgttcacagagagtaatggtttattaactacaattcatatatcctgagactagatgtgatttccttttgagctttgacataaaaaaagcaacaagcagtgctagtttgcttgaaaagaaactgacttctgttgtaactcgctgctgtaaaacatttttttttccagttaggcaaaaaaagtaggaataatctagcaaatggtttcaaaaggagaaaaaagtaccaatacttagagctgttaatgttcagcctcacctcagacatcaagttttctgattatatgtaatgcaaaaagcatattcatagaaataaaacaaagaggagggggaaatcaattatttcttcatatacctttttaatcttgcaagcttaactaatgacacactcagaaagagcattcttcataatgggtataaaaatggcctaatttgagagacaatgtatctggcatgcatacccagtaggtattcagcaaactcttgaggtttcatgttaacataataaaatattgtactgttcagcaaactcttgaggtttcatggtaacataatgaaatattgtactgttccttgtaggctaaatttttctttaccttttacaatccgtagcctaataatattttgttcaactgtacctgcgtctaaatttgaaattactttgctgaaaattgtagatgtactgttctgaagccactaaacttttccttttccttctcatcacaacctcatccaaatcttttattattagtttttagaatacacaccataaacattaataaaactcacttaggcatagctattttattcaggtgtcaggaaaggtgtccacctttgttacagtgttgacaatttggtttaacttcttcagcctcttcaataaggaaatgttggaatcaaatgtgattatacttgtgttagcctggtaatcactctgaggtgtgtggcttaatttaatttaaaaataagttgttgtgtgtataggggaagggcatttgggacagactcttgatgatttttcacaaaagtcaatgtaatatatatttataaacctataacttaaattcttaaatttgtatatctgaaggattcataaattttacattctcagatcctcacctaatgatatagtatttttcagattatatttaagtttttaatatgaaaaatttcaaacacaaaaaagtagaagagtaaaataaatcctcacatatttatcactcaattttaacagttactgagactttcccgagattgcttcaacattttacttggtagaagtattttacataaacttttcttttctttttttttttttctgaagaataacaaatataggaaaagtcccatataccataagaacataccagtataagcatctacatcaagaagcagaacatcagcaaaacgccaggatttctaatgccccttttgggactgttaaaaacgttagacagactccgggcacagaggctcacgcctgtaatcccagcactttgggaggccaaggtggatggatcacgaggcaggagatcgagaccatcctggctaacacagtgaaaccccatctctacttaaaaaaaaaaaaaaaaaaattagcccggcgtggtggcgggtgcctgtggtcccagctactcgggaggctgaggcaggagaacagggaggtggagcttgcagtgagcagagatcgcaccactgcactccagcctgggcaacagggcgagattccgtctcgaaaaaaaaaaaaaccaaaaacaaaaaaacaccttagagaaactaaatttaacagaccttcattgaacaaagaatgactcgtggattgggcagccccccgaacctgttttcacttcagagagattccggtgctatcgtgtgtggtcaaagaagatttatggctagaaaaaggaaagagacatacagaaaatagaagtaaggtacagaaacagtcagattggttacagatcagagtttgccttatttgaacctagcttgaagagttggctacctttgattggctgaaactcggtgattggcacaagagtaggttacagtctgtttacacgtgcagttaggttatagaaacctttaaatgaaagagacagctttatgttaaacttaatttaacaggctcagaaaacaatacataaaaacatggcacttttacatgctgaactaaagcggcagcctcaatgtctctatgaccttgccccgatcttctgtctctcaattttctccttcccaaaccacaggacgaaacccttctctgaaattcccttatctacctaaaaactggacccaccaaatagcaacgcatttgccttcgatcccctccctgaaatttcattagatggagaagaataaaactcatatttcagaggaagagactaagcattaaacagcacacccagggcccacacaaactttgtccaaaactattacctgttctctggtcccattcaatttccaaagagaatcacttacttaaaattgtttgagcattgggctcgttcattttccctgaaaatcatttactacctctcccaattgcctaaactctccatttctgtctcctctacgaagagtgtatgtaagcctcaaccatctggcccttcttggagtctcatctttgcaggaatccatgtccatatgtatgttaataaatttgtatgcctttttctttttaaaatctgtctattgtcagtaattgtaacagatcttcagtgggtggagaagaagctttctctccatccttacacccccctcaccatttaactccatccagatacctccatcactattcccaacttcaggagtaaccagtattatgacctctatcaaagcagattagttttacctgttttggaaattgtatataaattaaattatatagtatataattttgcatctgtcttgattcgctcaacattatgtttatgagactcactcagctgtagtttgttcattctgttgtagtatagtattcaattgaatatatagaccaccgttgatccattttaaatctgttgaacatttggattatttcctgtctttggtattagaaattgtgctgccgttaacattcttgtgtgtgtctttggtgaaaatatgtatgcatttctggtctgtattcatttgctaaagtagcttacagcaagttccagacattgttattttattcttacacatgagcatattttagtatgcatccaagaagtatgacatcttctcacataaccataattgcttgttaccatctgatgccttgtcctttattatttaaaatgcactattaaatggggaaatctcttttcttcagcatagcttttgaatatagcaagctgaaaatattgaagttgaaatactccgaagctgacagtagttttctttagctttgatagacaggtcagtcaaataatcaacaagtatttattgagctcctttttggtggatcaactaagtcatgttcttagctctattcacactcctcaatacactgacagaccaaatggaatttaagcggagaaaaccattccttttgataaattgttagtcatataattgtttatattaggtactacaaaataataattcaactcataaagaaaatggactgtggagcatattttaataaagagtgactttaatgaagagtgacttaagtgacatttttcctgtagtgaatgttatagctatatgattcctggcaaatatttagaataattagatattatattacataagatgtataaatataacaatattaatttaagtataaattaaagttaatatgttattataattaaataattaataatgaaaacatttaaggggttttcttatgcagatcctgcgtttgattttattttatgaacataatatcaattgtaagaggtgattttttcgcttgggatctatgacgaatcaaataatttgaaatatctttgcttgtattctcttggtttacgttctcagatgggacaactcttttgttaatagaaaacagtttttttgcctccaattttctacataattttttattctaaacactgaaaattgtctcacagacctggccttaagttctgattttccagcgtactagctctgtgatcaagatcaagcagcaacttctctgaggcccaatttccttatctaaatcatatggtgataattccttcctctgttttttgcatatttatttataaatgttttactatatattaagaagtttcttctagaggctcacaatgtgtataagaattcttttttctttcttttttttttttttagatggtctcactatgtcacccaggctggagtgcaatggcaaaatcatagccaaagaatcctcccacttcagcctccagagtagctgtgactacaggcactaagcctggctagtttaaacaatttttttttttttaagatgccggatctcactttgttgcccaggcttgtcagcataagaattcttagcatgatactttaatagctacaatttcaaaaatcaaaagaatagcaaaactacagaaggactagtcaaactttctgctttcggtttgaatcttttttcttggacttttggtcactcaaaacaacagaagcaatgacaacaacagctatgatttactgaagctcactatataccaagtactatattcattattttgtgtaaaatatttataattttcacaacaatgctgtaaatggtatggcaataattaataatagtaacttataccttgattacaaatgaagacaccaaggcttagagaatataaataattttttcattgtcacatagctggtaaatagcagaagcagtttccaattccttttacttttatttgactaggtcaagatttcttttatacaaagtaaattcacttttcactattatctttgcaaatagaattataagctctatgatgtagttatgttaactttcagtaaatttttaaagaaatgccagtaaataatgctgttttaccaacagcattttaccaacagtgccatttcactccgtgagtagtttcagattgtaaaaaattaatattcttcctattaatgtttgtaaagagagcctaaacaatttagaaaaattttatattaaatataaaatgtgtatattttcaggaaattatttttacaaggtaatagctttaaaatatagctacaaaataattggtttaatattaactaacttgattcatcttttgtgatacattggggcattaattagatgcacagaaggcgtcaagaaccttgactaactgctatgccacattttatatggagttatcaatgtacaggatcttagcattcattttaaagaaaagtatcattaaaggctctgttgcaaaatgtctgcttacgtaatgaggagtcatgtgatctgcctattcagaaatcacattgttatttatctatattctcatcagtctaatatcaaattatatttcatccttcccactttcttagatgcattcaatataaagaatgatggaacaactcaaaatgcttgaaaacagttgccactttgccttatacattataattatagctctagtctcttttctgattaaatattgagtttatagctaaacacagtggcaccagtatctaatcccagctactcaggaggctgagatgggaagttcaagaccagcctgggcaacatagcaaaagtccctcaacaaagaaaaaaacaataaactgaaaattacttacttctcatgtgttcaataaaatattagtattctaaacttaataaagattaccatgtggaaaccatattatttcttggaggaacaattaatgttttctagccctgcttgtctgcttccttgccatggtcagtgctttcaaaggtccccaagaggttggactgtgtgtgttgtgtgtgtggtgtgagggatgtgtgtgtgactatttttgtttgtgggaggtaaggggtaggatggagtggggatgaggatgtgataatttgaagtggctgttaattttaacttgactgcattaagaaatatctagagaactgatgaagcattacttctgggtgtgtctgtgagggtgtttccagaggacattggcacatgaatcagtggaccaagtctggaaaatctgccctcaatgtgagcagataccatccaattggctgggggcctggacagaacaaatgggatgagaaagaatttcctctccctttctgcctctctctctctcctggagtttaaacactctccccctcctacctctggacattgaagctccagactccagcattgggacttcaggccttacaccagcacccactgggttctcagatctttggtctcaggctgagaaacatactcttgtcttccctgattgtggtgctttagaacttggggtgagccatgtacccagcaccccaggctctctaccttgcagacggcctcttgtgggacttctcaatctccatagttgtgtgaggcaattcccctaataaatcctctacctatctatcatctatctatttatttaaacatatatcatattggttctgtctctctggagaaccctgactaatacagagtgtttttgtgggaaagaagtgagagaaaaacagaatacatcaaagacaggaactttcaaattagtgttgctaagtgtacagaggtacttcttctgaggtaaaactttcccatcatcagaaacttgaaagcctaaagaactttgctcaatatattgtgtaggggatttggatatttggatttaatatcaaggccacttacacatgtaagagtctaggaattcatgattctaaatgataggaaactacttagaggtctttggctggcaattatgaattagattaagttcaaagagggaaggtttttatttttcttcttgcatggctacaagagcagtttcaaacacatgataataacagttctttgtcttacaagatgaaagtttgattctactctccattctctattatcaagagtaattcaattaaaattttatttcaagctcatcttctatcagagttttgtctttggtatgcttgcattctaatatatcctatataagtcattcaaactggtgagcatctcatttggcaaaaagaatgcagttgtgtttttcataaacagcagtttggaaaactgggtacagagaacaaactgttcacttagcattgcagttactttgttctatttctctgtgatatgctctaattttattaccataaacaaatgataggcatagggatagaaagtggagtacaggccatatcctgaattggctttcaattgtgacttgttctgaatccattcgtacattcaagaatggctattctgaaattaaatttgcttggcatatctaggctatcattttcttttgttttatggagcttatcttcgttctgtgggatgatataattcaggtctagttggtcactctatcatttcagttggtgaagcttttcctcatggagattttattatgtttaggaactcattttctctttagctatgggatgaatgtctgtcattaacatcagtttttcctcaattttcatctttgtgtgacctgcatcagcatcacctgggatcattgttataatacagatttcaaaacagacatatggaataaaaaatgcagatatcttgatttttaactaattgcccaggtaattcttatttaacctaacatttaaaaccttgttcttctaacttattacatatattctcccaatttcactagtttctcaaagaaaggtccactacttttacatagcctggctcctttccctcagtcacaggttttcctcactgaggcaagtccccttgttgcaccataaatctttcctcctagttgccaggtctagaatctaatgtctcaaaagaatactttgatggttacaattattgatcaacttggctaggctatggcacccaattgtttgctcaaacattagtctagatattagtcaatggaagtattttgtagatgtgctgaagatctataatcaggtgactttcagtagattgacctagataatgtgggtgtgcctcatccaattagttgccttgaaagcaaaacctgaggtttcccagagaagaagaaattctgcctcacgatggacatagaaatcttggctgggtttctagcctgccctatggatttcaaatttcagacttgccagtcagtcacataaggtaaagcaattcctttttatttttttaaaatagagattgggtctttctatgttgctcaggctgttctcgaattccctttctatgttgcccaggctggtcttgaactctgggctacaagtgatcctccctctttggcctcccaaagtgctgggattacaggcaagccattgcacccatctgtaaggcaattccttaagctccatctctctttctttctttcactagaaaaccttggttggtacaaatactttcagttgtccatgtgacgctcatatttaggagcccatatcctcaagaactcctttgcaggtccctcagtatgtgtttatataaccaatagatctgtcttctgtcttgaatcttaaattattggttgcctcccctcagctggtctctaacacaaagccttatggagaacaatgaattccttccagttcatctaattgctaattattgtttgctacctgtactacttcattctgatctccgtttaatagattgagatcaccaaagctgtacatgtaggaaatggcattattcacttgactctacctttataatgaaggtagtatccccaggaccttagttattttagaatacaggtatttcagattctctctgctccccacccttttcccttgtcttctctgattttcccaagcagatcattatgccttgactctgagcactgatttatcaatataaatatccttagtgtgatcaaatagttatattgttattatttatttgtatgtttattattaccttgttccatgtcaaatttatgtctcaagttttaaaaaaaattaaatgtaatgagatgagatagtgagatgagaaaacattttatcttaacaattattggcctcagaattcttctcacagtgagaagagtttcagggtaaaaagctcatttgtgacaaattgtactttgtggcaaggatttggcagttgccaaaaccatatgttatagtggtaggcagtattacatagtggctcaaaggacaggctctagaatcagaccgtatgggttcaaatctcagctctgccactaattagctgtgtgaatgtggaagaatcactagatcttctagtttcctcatcagtaataaacacaataatattaacagttacttcctagggttgttgtgaaaaataaatatgataatacttgtaaaacaacacagtgtcggaagcacatgaagtactcaataaatgttagctattatttttttcattatcagaagagggaaagttgctctgcacaagacagagaagagaaggggagaggaaggcagggattctggagagttggggaaaacctgtaattatattacaatagtaaagtggcaaaagagcactcaaaaatagttcaggcttaatattctttgggaaattgaatagctgagatagaagctatttcctatctcctccttcaaagtctactaaactcatgaatgctttatgccatctgtgcgtgtgtatgtgtacattgaagagagtgatgagtttcatatctagattcaagctttgtgtaatattgtatacatggcagtgcaaccaggatggcaaaagtggttctgagaacatcaacccttcaagaatttgttgtaatttttggaagtgtttttatgggttagaaatcagattgtaagcagatacggaggttcttcagctgactgtaggaattcatccaccttgagcaatctacctgctttatagcatcctatcctacaggctgtcggttttcaagccctgtgtggtatgtgtccacctagtcagttgaaaccagttcctgacagacccatttatacatgaacctgagtgaactttcctcattgccatgctaaagtttccatcccaggaccagctgtggcttcattaccataacatgtgacctatgtgctggcatgatgactcaatgcacctgtgcaagtgggacccctcctctctatgcaacgatgcaccctctttcccgctccattgtcccataaaaccctcctgtcacttcccctcagagagacactgctttggagaatagttccagtgctctccttacttttgacaactaataaaactattcatcaaaacccatgttcttgtgatgagtcacttgttaacaggagaaagaaccttggttctttttgggtaacaagatcaagccaagtttgctcagttcaggacgggggacccccagataatatcttggttaaattcatatttttaaaattgttatcgtaaaaataggacatgctccttgtagtgctccatattagtcttcgaagggtgtcataaattagcaaagactagcactgtaaggttagctactactgcaacagtcactaaaaagtaattttaatatttacttgcatctatagaccaaaaatgaggatcaaatttatattcccaaactatactttctaaaataccttttttttaaattttactttaagttctgggatacatgtgcagaacgtgccaaataggtacacatgtgccatggtggtttgctgcacctcttattgaccttgttatttctctgaagactcttaggaaactcccaaaaccttcccagaaacccagatctttggatcacttatctccccctcccaggtctttgttatgtgttaggttggtgcaaaagtaattgtggtttttgtcattactttcaatggcaagtaagtagcatagcctctatagctaaggaagctctccattctctcattcttacacttttgcatcacaaaagaacaggtccagcaaggaaggaatcctcatgagaaagtaggaatggagaatccaaatgggcaatgacaaaactatctttcgtaggaaaagagaaaaggagagaaaaacagaatacactctcacataaaaaaccctttttttcctggtgatatcaaaaaatgtaaaagaaaaagaatcacctggaatctaatcacctatgtattttaagtttcttgagagggtctgagcttcacgcattaacatggattaatgttaatcattgtttgatagtatgttaatattaaatatataatgtaagccatattttaagatactaaaatcttaaaggatactaacaaaattgggccattaatatgctaagaaggacagcataagaaaaagcaattacaggacaatttctctaatacacatatatcatatatgagattatgctagcctcattaaataatatagggattataacctctatttctattctctggaagacttggatatgattggaatgatttattccttgaatgactggaagtcttcattcgtgatgttatttgggtctggagttttccatgtggcaagatgtttcatttcggattcaatttctttcatagcataagactacgcaggtcattttatttttgcctaaatcagtcttataatttgtactttctagaaaattttcatactcatctaaattttcaaatgttttggcatgaagttgtttataatatactcataagtttttggaatctgcattatctttaataattcccttaactgtgtcttaatagtagcaatttctactagtttattgttcctatctatttaattctggaatagaaagggaacagaattcaggtagcatgatgcctccagctttgttcttttggcttaggattgactttgcaatgcgggctcttttttgcttccatacgaactttagttttttccaattctgtgaagaaagtcattggtagcttgatgggaatggcattgaatctataaattaccttgggcagtacggccattttcacgatattgattcttcctatccatgagcatggaatgttcttctatttgtttgtgtcctcttttatttcattgagcagtggtttgtagttctccttgaagaggtccttcacatcccttgtaagttggattcctaggtattttattctctttgaagcaattgtgaatgggaattcactcatgatttggctctctgtttgtctgttactggtgtgtaagaatgtttgtgatgtttgcacattgattttgtatcatgagacttcgctgaattgcttatcagcttaaggagattttgggctgagatgatggagttttctaaagatacaatcatgtcatctgcaaacagggacaatttgacttcctcttttcctaactgaataccctttatttctttctcctgactgattaccctggccataacttctaacactatattgaataggagtggtgagagagggcagccctgtcttgtgccagttttcaaagggaatgcttccagtttttgctggaggcatcacactacctgacttcaaactatactacaaggctacagtaaccaaaacagcatggtactggtaccaaaacagagatatagaccaatggaacagaacagagccctcagaattaataccacacatctacaaccatctcatctttgacaaacctgacaaaaacaagaaatggggaaaggattccctatttaataaatggtgctgggaaaactggctagccatatgtagaaagctaaaattggatcccttgtttacaccttatacaaaaattaattcaagatggcttaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactcaagaacttctgcatggcaaaagaaactcccatcagagtgaacaggcaacctacagaatgggagaaaatttttgcaatctactcatctgacaaagggctagtatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatacaaatcaaaaccacaatgagataccatctcacaccagttagaatggtgatcattaaaaagtcagaaaacaacaggtgctagagaggatgtggagaaatagaaacacttttacactgttggtgggactgtaaactagttcaaccattgtggaagacagtgtggtgattcctcaaggatctagaactagaaataccatttgacccaggcatcccattactgggtatatacccaaaggattataaatcatgctgctataaagacacatgcacacgtatgtttattgtggcactattcacaatagcaaagacttggaaccaaccctaatgtccatcaatgatagactggattaaggaaatgtggtacatatacaccatggaattctatgcagccataaaaaatgatgagttcatgtcctttgtaaggacatggatgaagctggaaaccatcattctcagcaaactgtcacaaggacagaaaaccaaacactgcatgttctcactcataggtgggaattgaacaatgagaacacttgaacacagtatgggaaacatcacacactggggcctgtcatggggtgggaggaggggggagggatagcattaggagatatacctaatgtaatgatgagttaatgggtgcagcacaccaacatggcacatgtatacatatgtaacaaacctgcacgttgtgcacatgtaccctagaacttaaggcatatatatatatatagtcatcttaaaaaaaaaaagggaacagaatttcctttctttctttcataccactctgtaaaatgtctactgccttttaccctgagaatggcatggtggattaaagatgaacatattgccaggtgcagtggcatgtgcctgtagtcccagctacttggaaggctgagacaggaggcttgcttgagcccgtgagttcaaggctgtattgtcctaccatcatgcttgtgaatagccactgcattctagcctggggagctgactgagaccccatctcttaaaaaaaaaagatgaccatacatttcttgatatttctcccatgaagtgaggggtctagctccccccatctttgttaaaatatgccccgagctgacagatgaaatgaactcttggggccaaaatgaggcacaccagaaatagaatcaagtggccatatcagggagaagggttgggcatatacccctatattactagctgccataacatcttctgtcctgtaattgaacagaaactaaccctcaaaaaaacattgttaaaacagctgctgggagtttcccagctgcccgatcctactggattgcctaacaccagtcactggcaactggactcactacacagcccctctgccccctccccacctcccaccagcagctctgagttgacaatagacctactgtgtgaactgtgtttcctgataaacacccacagaccttaagccagtttcaccaggtttacagaacctgttcacggaatgtttttgtgccccacagaacatttttatgcccttcagttcaccttttggtgtaaagagccaaattttacctcattttaacattaaaatttcaccctaaaatgagcctaaaatatatattacaaatatgtttactcattgcatatatgcttgactttccttgtaaatattcacaaactttccccaagcctgctaaatatgcaccttagacagactgaaagatgtaaatgcctcttttcctctctccttctttgaccatactttcattttacattggaggctatgtcttcccatctatagattttttaaaaaatagaaaataagactctcccattttcctccacagatttcatggtcttgtgttaacatttcaaatctggtttggacagtgagtgcattgacacatagtgtatggcaggggggcccctggccagtactggttcatgtcttaagaggaatgagggctcctaaaatccttggaatctctgaagtgataagtgtcttttataaatatttgattatataacaatccctgttgattgctcatttgaagatgctactacttgtgttctccagaacacatgttggtaaatgatgctttaaatttgttaggttttgatgtggactacaaaatcattaaattctggttctagtaattgccaaggatcttgtattagaataatcatcctgcatataacaattgtaaactgtggatttggttaaaactgcacacacttgaagtcatggagtttaatcaaaagcagggaaaataatagtaagaacaacaacagcacctgaaaaaaacttgattcttgaaaggagagactgccctgagtgagattcaccttgatacagacttttccccggatacatttcctaagttggtgcagtgcagggcagctagacttgaatgaagagccacagaattattggcttgagatgtcagaggacggagttcagggctaccagaacagcttgaaaataataggcataaatctcataaactggagtgccacagtgtggagagcccccaactttatatataatctctcctcaaatccttgactagcctttgaactgggcatgcatgagaaagactgtaaacagttaagtggatatcaagttggaaacctgaaaaaagatgagcagagatttcagctgctgcccatcacaagggagggagagacagtttggagtttgggtcctaccaagttactttatgctagaacaacaaactcaaagctcttcagaggaaaggaacaaaattccgtgtctaaaatttgtcattcacaatgtccaatatacaatactaccttttctaatcatgcaaaacaaacaaacaaaaaaacaaaaacgggaaaatgtgaccttctagttcaggggaaaaaaaaaagtaacaaatgaaaaccgaacctgagatagtacaaagcttttcatgctttaattaaaagacagagattctcagactggataaaaagcacaactacattcagtcaacaatagatgcactttaaatataaaggcataaattgaaagtaagaaactgtggctaggtgcagtggctcatgcctgtaatccaagcactttaggaggccaaggtgagtggatcacttgagcccaggagtttgagaccagcctgtgcaacataatgagactcccatctctacaaaaaataaacaaaaataagccaggtgttgtggtgtgagcctgtagtcctagttactcaggagactgaggtagaaggatcacttgaacctgggaggctgaggctacagtgattcgagatccagccactgcattcctgcctgggtgaaagagcaggatcctatctcaaaaataaataaataaatagaattttaaaaaagaaaaaaagtaaaaaactggaaaaaggtatacaatgcaaacaataaatataagaaatattggcatagctaggttaatgtcagacaaagaaaacatcaaaaaagtaattattagaggtaaacagaaatttctagataaaaggtcaattcaacctaagatataatcataaatatatatacctaaaacagagactcaagataaatgaaacaaaatcaaagccaagatagaaataggcaatatcacaaacatagatagggattttaatacagaactctcagaaattgatagaacaaatacaaaatcagtaagaatccagaagatccaaatgacactgtgtccggaattggtgggttcttggtctcactgacttctagaataaagccgcggaccctcgcggtgagtgttaccattcttaaaggcggcttgtccagagtttgttccttctgatgttcggttgtgttcggagtttcttccttctggtgggtttgtggtcttgctggctcaggagtgaagctgcagaccctcgcggtgagtgttacagctcttaaggcggcacgtctggagttgttcgttcctcccggtgggttcgtggtctcgctggctcaggagtgaagctgcagaccttcgcggtgagtgttacagctcttaaggcggcacgtctggagttgttcgttcctcccggtgggttcgtggtctcgctggcttcaggagtgaagctgcagaccttcgtggtgagttttacagttcataaatgcagtgtggacccaaagagtgagcagtagcaagatttattgcaaagagctgaagaacaaagcttccacagtgtggaaggggaccggagcaggttgccactgctggcttgggcagcctgcttttattctcttatctggccccacccacatcctgctgattggtccattttacagagagctgattggtccgttttgacagggtgctgattggtgcgtttacaatccctgagctagacacaaaagttctccatgtccccactagattagctaaatacagagtgtcgacacaaaggttctccaagtccccaccagagtagctagaaacagagtgtcgattggtgcattcacaaaccctgagctagacacagggtgctgatttgtgtgtttacaaaccttgagattgatagagagtgccgattggtgtatttacaatcccttagctagacataaaggttctccaagtccccaacagactcaggagcccagctggcttcacccagtggatcccgcactggggccgcaggtggagctgcctgccagtcccgcaccatgcacctgcactcctcagcccttgggtggtcgatgggactgggtgctgtggagcagggggaggtgctcatcagggaggctcgggctgcacaggagcccatggttggggagagggtcaggcatggtgggctgcaggtcccgaaccctgccccgtggggagacagctaaggcccagtgagaagtagagcacagcagctgctggcccaggtgctaagtccctcactgcccgaggccagcagggctggctggctgctccgagggtgggcccaccaagcccatgtccacctggaacttgtgctggcctgcaagcaccgtgtgcagccccggttcccacctgcgcctctctgtctacacctccccacaagctgagggagccggctccggcctcggccagcccaagaaggggctcccacagtgcagtggtgggctgaagggctccttaagtgctgccatagtgggagcccaggcagaggaggcactgagagcgagcgaaggctgcgagggctgccagcacgctgtcacctctcaacaccatctacacagcaactggtagaactaataaatgaatagaacagtcacaagagttaagttcaatatacaaaaatgaattgtatttctgtattaatataaaccatttttttaaaaaaaattcagtttgcaaaagcaccagaaaacataatatacttaggaacaaatttaataaaatatatgtaggacctctatgctgacaacttaggaaacagtgctgggaaaaaataaagacctaaataaatagtttaaagactcgctattgctaaaattacaattctacacaaattatctatagatttaacgccttaccaataaaaatcttgtctattttgagacactgacaaattgattctaaaattgacatacaaattcaaaagatctagaatggccaaaacaattttttaaaaaaataaaacaggtagggaatttacattacttggtttaataatctactttaaaactatagtagtcaaaccaatatagtattagcgtaataatagacattataaatcaaaatagtctaaaaatagatccacatatgtacagttagttgattttcaacaaagattcagtaatgtgtgcttactcattcaagaatattaaatcttctgtagaacggggaatgggaatctttttgttaaagggccacagagtaaatattcaagacttgctggctatactgtctctgctgcaactattatactcagttcagcctttgtagcaggaatgcagctatagataatatgtccatgaaaggttacaggtgtgttaaacaaaacattatttataaaaaccgatagtgagcctgcaggtcatagtttgcttatctctgctatagaacatgggaaaaacaaatacagtggataaatgaagctaaatatggtaataaccctatgtgtccatgggttcaatcaactttggattgaaaatattaggaaaaatactgcatcagtactgaacatgttcagacatttttccttgttattattccctaaacaatatagcataacaactatttaataactaatctagagatgatttaaagtacaggggaggaagtgcatagcttatatgcaagtactatgccattttatatctaggacttgagcatctttgggttttggtgtctgcaggagtttcttagatccaatcttccacaggtactgagggatgacaaagcaagtggcttgtgagacatgttaacacaaataaagtaagtggactggaacatctgtgttttgtttatacataaaaggatagaagagctcagaaggaccacatgggtactgaatattcgtaatgtgtctggaattggttccttccagtgggttcttggtctggctgatttcaagaatgaagccacggaccctcgcagtgagtgttacagttcttaaagatggtgtgtccagagtttgttccttcagatgtttgtagtcttgctgacttcaggagttaagctgcagaccttcacagtgagtgttacagctcttaaaggtggcacgtccggagtcgttcattcctcctggtgagttcatagttttgctgacttcaggagtgaagctgcagaccttcgtggtgagtgttacagcacataaagttagtgcggacctaaagagtgagcagcagcaagatttattgcaaagagcaaaacaacaaagcttccacagggtggaaggggacccaagtgggttgctgctgctggctcgggggcctgcttttattcccttatttggccccactcacatcctgcttagtccgttttacagagtgctgattggtccgttttacagagtgctgattggtccatttttacagagtactgattggtacatttacaaacctttagctggacacagaacactgtggtgcatttacaatcctttagctagacagaaaagttctccatgtctcctaccttattagctagacacagagcgctgattggtgcatttacaatcctacatagctagccagaaaagttctccaagtcccctacccgatgcagaagcccagcaggcttcacctctcaatcccccctctaaacaggacaccccaactgctgttgggaatttgcccagtgaccgctctagctacttcctgctggataggggcgaagtagcggccctgcagttgtagtgtcctccagaggggaactctttaggccagtggaagggccagtgggtcggtccaggggtcctcagtagaagttgttagttgaactcatttggggttccatttgtaagatcgtctgtagcttgatggcctccattctagaggaaacaaatttgacaacaaggttaaaaataaagggcccaaaggcgagtaataacaagatggctgccacgggacctagaaaggggagaagccatgttgcccaactccagaggttggtataatagtttgaaaggcgttgtctgatttcagaagccttttcctgtaaatgccaggtggcatctcttactatccctgactagttagtgtagaaacaacactcttcccctaagaaggtgcagagtcctcctgtctcagcagtgaggaggtctaggcctcagcggttttggagcatcactgctgacaaagagtctgtttgggactgtaaagtaaggataggtttcgttatttcttgcaaactgtctgagaaatcctttgagagtgtgtggtaataggataatgaagtggataaactggctattctggttcctgtagcagtagccattcctaaccctgtaagtaggggcattagttgtatggctctgtgctgacggacttgagctttgaggggtactaataaggtctgatttcctggggcaatgttaatgttggcacttagaaagactaaggtgcaagtgcctgtccagttagtggggaggcatatataggtcgatgttccacataagaagaatataccttgactggtatataccttgaacgggttgtgtatgttaaaaagatgaaaaggtgtgtgaatttgttgttttcattttcccataccttagagtacttgctaaggtagctccagtgaatggctggaaaggggtgttgggagtgaactgagtggctccctgtgttctgttttcccattggagaaaaaactgttttgtatctagtaggaaccattcgagagagtgattgaaagaggggatgagaaggcattcactaatgatggaggtgctgctgcaggggatccaggggtgaatggtcatgcagggagtatgtttgccattttaaaacctggactgtttgttaagcagggaggagatgatgatttttggggaccctgagaagcagacaagccatctgaatggagctgtttgggtgactcagaagttactatgatcagctggggtttgaagttgtagggtgtagttacactgatggggtagtaggtgccccaggggcaggcctgataacaggttgcattggatgcataaaggggcttggaaagttaagatggtattcgtagttacaggaccgtgtatgggcttttcattgcttttgtaataggtgaggttggaaatgtaagaacgtaaaagttggattgcacatcccgttagggtaattttggtcctatcagagatggggaagttggctaatgattgcatatttagaagttggaaagggtcttttccttctaacgaggatagtaggttaaattggtaaagatccagttttttgtgggaatgggagtggcaacgtaagcagaggttgatagagagataaaaagccaacagtcatttgccagggaaggattggactggtttaacagagagtgggttaagttgagagtcttgtagaggtaataaggagctaggggaaggcgagaggtgattgtatgaagtatccaaggaagcaggaggggtagataggcaaagagtaaataggaaggtaaagagggtactctggaagacgagatcattttatacaggctgagttaaaggtaggagtaaattgctgtcagaaggaaggaagatagaaagaaggttgatgtgattaggattttcatcgcagcaggagctacagtatatagtcctatcacaaagagtatagttagtatgctgcttaataatacgatgaaatagtaaaaggattccattaaaggggcaagcagaggtgttaaagataaagattatgtaggttttcacttatcttttttaaggagtaaggggtttttcttcaggatcagtgttacgagcctttttagtctgggatgtttccttctgaaataggagatgcaagtcctccaatggtttgcaggagtatcgaggctggtctgactgatcttgggactcctgaactgatggtcccgcaggttccttaggggatgtccaaaatttaactcaggtgtggtgaatccaagattctactcctgccaccttaactgcagtggggatagagaggaatattgagtatggccctttccacagagtccataggtggggaggaaaaggggagagatttgaccaacactagatctcctggttgaaacaactctgttcccttttctctgtgacatccttcaggtaggtttttaaggtttagttgatattttgccaaagaagttatatctttgaccaagttggctatttcctgatcaagtaggaggtcatttctgagaaaaggtcatccatacatcatttcatatggaccgagctctgttttgtgaggagaatttcagattctcaacaaggccatgggcaaaagagtaggccatgggagatgagtttcttgtgttagtttcctaaagtgcctcttgagtgtttcatttgcctgctcaaccttccatgtggattgtggccgccaggcacatgaaggtgatattgtatccctagagccctggaaattccctgagttatcgtggctttaaaagccggaccattgtcactctgtaagctttgaggaagcccaaatctaggaattatttcatgaattagggcttcaatcacttcctgagccttctctgtcttgcagggggaagcttctaaccaatttgtaaaggtatcaacacagaccaacaagtattgaaatccctttgacttaggcatatgagtgaagtctaactgccagtcctcaccaggatagtgacctattctttgttaccccaaaggggccttatgatggaccgagggaatattcctttggcacacctcacaggctttgactacctgttggatggtctggagaagatttggccctgtaaatagggatttggccatttgatgagtgttttcaatacccatatggaaagtttggtggagggttttaagtattttccactggctggcttcgggtataagtacctttccttcttctgtcattaaccaccctgaggagagaaaactctgcccccatgaaagtccccattctgtttcagttggggaatactggggcttaatctcttggagggggttgttccataccaagggtccttccataggtatttctaatgggagcttctgcctggcagcagttttggcctcagcatctgcccagcggtttccttctgccttttctccttcacctttctgatggctttggcagtgtaagactgccacctccttgggtttttgcattgcatgcaataactccgtaatttccttgtggtatttaatgggggttcccccagaggttaggaactccctttctttccatattgcagcatgggcatgtaggattagataagtatacttgctatctgtatacacatttattctttttccctttcccagttctaaggcttgggtaagtgccactagttctgctaactggatgctggtccctgggggaagaggcttactttcaagtatggttatatcactaactatggcataacatgccctttgtatcccattctccacaaatgaacttccactggtatatagattaaggtcaggattagctaaagggacttctaagagatcatctcgggcagcataagtcaggactataatttgttggcagtcatgctcgattggttccccatcctcttggagaaaatggcagggttgagggccacacacatatgtatttgaagaaccagtccctcaaggagtagctcctggtatctaagtaggcagttgtctgatagccataaacttcctttggcacctagtatgccatttacatcatgagtagtccagacagtgagatcgtttccttgtattattttgatagcctctgacactaagttagctgccaccacaactactcttaaacagtgaggccagccttttgctactacatcaatttccttacttaggtatgccactagttgtggggttgtcccatgagtctgagtaaggactccaagagctatccctgctctctctgtgatgtataaagagaagttttgtcctgtgggaagacttaaagctggagcttgtactagggcctgctttaagggtttgaaggctgtttctgcctctggttcccattctacttgatgagtatttgccctctgaatctccttgattagagtatagaggggcctggctatctcactgtatccggggatctgtagttggcaaaagccggtgattccaaggaaccctcacagctgttttaatgtcttagggtgaggataagccagtataggctgtattttttccttgctgagggtcctggtccctctggctatgattaagcctagatatttgacctgctgtaggcaaagctgggccttcgacgtagacggtttttacccttgattagctagaaagttcaagagatctagagtagcctgctggcatgaggcttctgaactggtagccaaaagtaaatcatccacatactgaagtaccagagtgcctggacttgagaagtggcctagatcttgggctagtgcctgaccaaagagatgagggctatccctacacccctggggcaagacggtccacataagttgggacatgtggtctgtgggatcctcaaagtcaaagagaaactgggagtcagagtgcaggggaataaagaagaaggcatccttgaggtccagaacagtgaaccactatgctttctctggtatttgagagagcagggtataggggttgggtacaactggatatagaggaattactgcctcatcgctgtgagtctaagatcttgcactagtctccactgaccgttcagtttttgtactcctagaattggggtgttgcagggactgctgcatttccttactaagccttgagcttttaaatgtttaacaatatcctgtaatcctttatgagcttcaggccttaagggatattgcctttgataaggaaaagtggtgggatcttttagcctgatttggactgggcaggcactttttgcccttccaaattgtccttccaatgcccagacttcagggttggttccctcttcaagtaggggacaacaaatgggtaacttgttccccatattcatgtagataatagctccagctttggctaatatatccctccctaagaagggtgtgagactttcaggcatgacaagaaaagcatgtgaaaagagcaaagtctcccaattacaactgaggaggtgggagaaatacctggttacaggctgtcccaggattccttacatggtaatggaccttgaggacagtcatccaggacaggagattaacactgagaaggccgcaccagtgtccaggaggaagtcaatttcctggccctcaatggttaaatgtacccagggctcagtgagggtgatgacatgagctggtgcttgccccgggcaccctcagtcctgttgttgaattgtctggttggggacttctgacccagagaacctttgtcctctggggcagtgcaccttccagtgattgcctcagcatagcagacatggacgagggggcagcttgtttcttgttggacaatcttttttaaaatgtccttgtaaaccacactgataaaaaaccctaccaggtgattggcctgctccattttctgtcctctctgaaccaccaaagtttgtctgagggccatgattaagggtgcagcctttctctgatctcgcttttccttttgggcctgctcctcttggtccctgttatagaacaccaagattgctaggtttaataatgcctccagattgtgttcagggcccagggcttgcttttggaactttctcctgatatctgcagctgattgggttataaacgtatctttgaaatcaattgacccttgagtgatttgggtgaaaggagagtgtattttcttaaggcctcctgtagctactcaaggaaggcagaaggattttcttcctttccctgagttatggtggacatcattgaataattcatgggctttttcctaattctccttagtacttctagaacagaggtcaacagatatttacgactccagtccccatgatctgatttgaggtctcaggggggattcatactggggacggcttgctgactggaagggaatttgtccctttcttcagctgtcattctatcatttacttgactaagataccaggtatctccaaactctcaggctgcagctaaagccacattcttttcattaaaggccagggtttggtctaccaatagcatgacatctctccaagtgagatagaaggtttcccctagactctgttggacatctgtgtgcctatctggatcatctgaaaacttccccaggtctgccttgatcttctttaaatcagagaagggaaaagggacatgtacctgggttgggccaaattcccctccccctaaagcttgaaggggacataactaatagccttggggtttttgtggtcctttgaagatgtctttgattatttccttctgggcaggggagattagaggaggcttatcattactaggaaggggagctatagggaggataggatacaggggtaagctgagaggtcctcctgggggatgtaaattgcaagctttgcctcattgtgtattctccttcaatgaaaagaaagcttggacataaggtatttctctccatttgccttccctcttacagaaaaggtcaagctgcaggatagtattataatttatacttccctcaggtggccatttttccccatcagggagagaatattggggccaagccatagtgcagaaaaaaatgagctgcctctttttcaggttttttgggtcaaattggtctcaatgccttaggatgcatttctcaagggtgagcctgttgatgcctgagtgtttcccatctgaaagacaaaaccacccacggtttttgtttgtttgtttctacccctgcccaagaacctgcaagagtccctggaccctgctgatcagaatagttgtgctcattgacgcggtagcagaaacaccccctgcccaagaacccacagtgtccctggaccctgctgattggaatagttgtgctcaccaacgtagcagcagaaatgctaattttcctcctagaccacaaggaggaccaaggaaggtcagatttagtggcccttaccgacacattctagaaaacctgcacccttgcctgtcctcctagaccacaaagaggaccgagaaaaatcggatttatttggcccttaccgatgcattcttgaaaacctgttagagtcctaagtgttcttctgttaatactgggacgttacccccatcctataaagatgttattccccaaaaatgaagtagagggccataccctgagggagggaagggatctccagagttggaagaatgatgtcttttgtcctcacttatgtgaataggaaggctacaatttctgaggctccccatatcctagcttcaggaatagcttttgttaggcctgcttgtctgaggagggatcctaaaattccagatagtacccccctacaacggggctttgggcaaaaattatgtctttctgattggtgagaccgggtgcctacagaaggtaacagagtcctagagtttatactagaaatcattcttacaggagaaactagaaaagcaccagagacaaggagtggtttttagaagcgggactagccttggagaagagaggtgagaggaagtttgtatgacaggcattcgaacccaggaggcaaaggtcaggatggataggatagatgggcgagtcttgcttgggtaacatgacgttgagagttctgctcatggccacagggtcaaccaacttgttgtcgggaccccgtatctgaatggctttcctctctgtcgatcctaagctcggcctggatttacaggaaaagcagaagctggttccaggcaaaccaacgctcccaagtccaaagagttgggggttgttagccctttcccagaaagcctgacacccgagtctttagtccagtggctgtgctagttgcttttaactggccaacaggtgcccggtatttggcccctgaattctaaggaaaaataggacagaatagcaagcgaaaggggtccaatggtactcaacacttggtgataatcaagtatcccatctggggcaccgaaatgtgtctggaattggttccttccggtgggttcttggtcttgctgacttcaagaatgaagccgcggaccctcatggtgagtgttacagttcttaaagatgggtgttcagaatttgttccttcagatgtttgtagtctcgctgacttcaggagtgaagctgcagaccttcacagtgagtgttacagctcttaaaggtggcatgtccagagttgttcattcttcctggtgggttcttggtcttgctgacttcaggagtgaagctgcaagcctttgcagtgagtgttatagctcttaaaggtggcacatccagggttgtttgttcctcctcgtgggttcgtggtctcgctaacttcaggagtgaagctgcagaccttcgcagtgagtgttacagctcataaaggtagtgtggacccaaagagtgagcagcagcaagatttattgcaaaagaacaaagcttccacagcatggaaggggaccccagagggttgccactgctggctcgggtgacctgcttttattcccttgtttggccccactcacatcctgctgattggtccattttatagaaagctgattggtccattttacagagtgctcactggtccgttttatggagtgctgattggtctgtttttacagagtgctgatttgtgcgtttacaaacctttagctagacacagagtgctgattggtgcatttacaatcctttagctagatagaatagttctccaagtcccctacccaattagctagacacagagcactgattggtgcatttacaaacctttagctagacacagagcactgactggtgaatttacaatcctttagctagacagaaaacttctccaagtccactacccaattagctagacacagagcactgattggtgcatttgcaaacctttagctagacagagagcactgactggtgcatttacaatcctttagctagccagaaaagttctccaagtcccctacccaacccagaagcccagccagcttcacctcttagtagcacactaaataaacatgagccacatgagtctcccaatattcatgaggatttaaataggtcacttattgatgatgcctcctctagcctcaatgttcttacccagtaacacaagttaaatttgtagctgctcatcaccttaactggtgaaccctgactgtggtcagttgtactttccccaaagtctctctagcataactgtgtatgtagctggctctagacaccttccatctgctgagtcctgtttttcaaatctcaaacaaaccatcagctgaaaactctgataaggcagagagattgagctataggacatataaatacagtataagctgagattcaggtattctaagtgtattaatatactcacctctttctttttgtgtctttattttacacttattccttaagccatgtgtttttagtacaaccttaatttagtctgtggacatttctgtttttctgacctggaaggtggctttgctggtagggtatctggaggctatcattacatcgaggtaatttcctgcatgacatgtaccaggcaattaaatgggaaagagaaaagccttctcaacaaatgatcctggaacaactagataaacaagtggaataaataaactttactgcctaagtctacactgttccctaaaatgaatttcagatagctcatagatggaaatgtaaaagataagcatataaagcttctagaatgtaatgtgggaaaatatctttgtgaacttgtggaagggaaagcttcttaaaaaggataaaaatttactaatcacaaaataaaataagttgaaataataaaaattaagttttgttcatcaaaagacactcttaaaaaatgaaaagacaagttacagatggaaagaaaaagttcaggaaatatatctgataaaggtattacagtaagaatttacaaaaatgtataccaaccaaaaaacacataacccaacataaaaatgggcagaagacttgaacaggcatttcataaaataagatatataaatgaatggacaataacatcaaatattgttagtcattagggaaatgcaaattaaaattgcaatgagtttttttttctttcttttagagatggggtctcactctattgcctaggctaaagtgcagtggtgtaatctcagctcactgcaacctctgcctctcaggttcaagcaattcttgtgcctcaggcttctgagaagctgagactacagacatgcactaccatgcctggctattttttctatttttagtagagatggggttttgccatgttggtcaggctggtcttgaactcctgacctcaagcaatccacccacctcagcctcccaaagtgttgggattaacaggtgtgagccactgtgtctggcacaatgagatgttaatatatttcaaactcatagaaaggcaaaaattaaatttaatttcaaagtttaatttaataaaattaaaataaatataaaagaggctacttttatgtgctacttggatacagacctgacaaagaagaaactgcataaaaaatgtcaggcagatcaggcaggaaaatactatgggtgatttctaggactgttacaagagaactttattttatcttttatttatttaatttttttatttttataggtacacagtatgtgtatatatttatggggtacatgagatactttgataaaggcatacaatgctcaataatcacaattgggtaaatggggtatctgtcacctcaagcatttatcctttctttgtgttataaacattccagttatactcctttagttattttaaaatatacccaacaaaattataattgactgtagtcaccatattgtgctatcaaatactagatcttactcattctattcattctaactatatttttgtactctttaaccctgcccactctccccttccctgactacccttcccagcctctgatagtcatcattctaccatctatcaccatgagttcagttgtttggatttttagcctgcattcatgagtgagaacatgtgaagtttgtttttcctacaaatgggtgagaatataagaagaaaggacaaagtgccttatttcacttaagaaaatgtggtacacatgcacaatggagtatgattcagtcataacaaagaatgagatcctgtcatttgcaacaacatgtatggaactggaggacagtttgttacaagaaaacttttaagagaaacttatgtggccccagaaaaagtgtgtatgtggtattaggagagacaaatatactaattgaaaggaaatttcttaatgctatattctcttagatatatatcctgtgcacaatctgaaaacatactagtaaggttctcttgaataaacaatcttattaggaaggcaaaattatttcaggaaggaataaggatgagaaaaaggatagggagaaggtacaaattatagtgtgtctgggcccaaaaggggaccatgactactttacatgtcagtacaatattttttaacttgtctgcctttgcttgagggatacttgaatgtcccccttccccactttcccaaccttggggtgaatgcccaatcttagcagccttgggaagaagtctggatgatttaatcaaacacatttacttatgcttcattaactttggaagatgagctgagagaatagtaaagtgtggagatttgcatactaatgaattcacttcaggtgatgccatagatatttatgatggaagaacataaaaaaaaggaaatgcttctgatcttttggtgggcagaatgttatataatgaacctctcaaatatgtcaacatttaccgtaagcttcatccatagaaggattgtgagcaaaagagactaaaaagaaaaaagaaggaggagaagacagacatacatttggaaagatatcttatgtaattactttttgataaaaataagtacagtatagtgattgagatacaaaggatataaaaattcttgcctatgttggaaagaaaccctatctgtctatagtttttaagagctcctagtgggcatgagttggaggtctttgttacttatagaggctgagaggaaaagaggagagaatccaggaggatccaagtcttctatctttacttcaaccagagatgctgcgcttttatctattttctctcattgtacttgcgtgtaaaattgtgtttgaagatagtttccatggcaaaacatcatttttttaagaagctaccttcttacacccttgctgtcaaagtaggttgtaaatttactgtgagcagagagaacttctctactcttgagaagtgattagtatcttgctttcacatgggaggcaagtaaatacataagtaaaaataatacataatgggcaaacatcatcaacagatgagtaaccaaagaacaaatatagttagttaatttatgaaaacatctttaactttcatcaacagagaaatgcaaattaaaacaaaatactattttttcctgtaccaaattatctgagattctgaataaaggaggttttaaaatgttaatgccatgaaatacaatacatatagtgtaatttatgcaatgtactcttaaacatttcagaaaaaaattatatctatattcacagagagagaaaaagagataaagtgaaggcaaatgtaataaaatgctaacattcagggaatcgggtgaagggtattgggggaattctttgtgttattcttgtttctttcatgttactcttacattacgtcaataaatacattctccaaaaataagaaaaagataatatggcattagagatatatatagttaagaaaatgattaaagtcaatgagtaagtactaagaaaaaaatacaaaattttgactatcagtgaggatgccatgaaagagtcaatgttacatactgctagtagaagtagaagttgggacaaccctttgcaaaatatttgatgatgtatatttaaattctttgacaatgttcatttcattttatttgattcatttcatttatttcatattcatttcatttatctggaaatctcctaaggaaataacataaaatagcttcctgtacaaaacatgtcaaatctagtattatttataaagctgaaatatgtaaggaacctcattgtctttcagtaatcagatgattatatctattatggtagagccttatgattgggtattatataatactaaatataatgatgaagatggtagctaccatatgctgacatatagttactgtgtatcatgagctatactatgtccttttcaagcctatctcatgtagttcttgtaacagtcttcaaattgacattcattaacagtttattttattatgaaaaacattgcagggtgttaaatgtaacattttaggcaatagttatgtgctaatttgatactaaaatataataaaataaaaactttttttttttttgagatggagtctcactctgtcaaccaggttggagtgcagtggcatggtctcggctcactgcaacctctgccccctgggttcaagcgattctcctgcctcagcctcccaagtagctgggattacaggcgcatgccaccgcgcccggctaattttttttttaataatatttttggtagagatggggtttctccatgttggccaggctggtctcaaactgacctcaagtgatccacccaccttgacctcccaaagtaaacatttaataaggaaaagctatagtagaaatgattttagtagaagtctagacatagtttttatttgaaataccataaagttaaaaacatttttgtaagtatcagcagattaattaagaaatgtgtagttggtgtttatatttaatcctaattgatttctgaagacaaaaaattaatatatttttataacaacagcaacgtacattataataattggtctgagaatatttgatgcctagataagcttaaatagtagattttctctgtttttatctgcactgtactataatcaaaataaacatataatttgaaagacttgtttctgataaaacaaaaacaaagtaaatgtaaattatggtatagtataaatgtagtagaaaaatgcggtataaaaaagatggtgttcccagaattttaaagaatatacatttttagatgtaaaagttagtaaattacattttaaaagaaattttaacttaaaaaacctacagttgttatagatacattaaatacattacatgagaactggaatttctcaatgggataatgatattggctattacaataatgcaaatgttgagtgaaatatcttccgatttgaaatcaagactaagtatcataatgaacataacacagaaatgaaaatatcttttccaaaaaatatttacattaaaattaagtccacaagtataatacattttctaattctttgtagccaagaatcatggatagattcagaaaatagttttaaatattttatagagctactaggtattttatatcttctgcacaaattctaagtagatttaggctaatttttattacataccataaagttaaaaacaaaaggtaaagaatgtaaccaactgatgtcaataaatagaaaacctagcatggatgttcataaagttgtactgttgaaattatctatcccagcatcttcattgtctgcatgaaaatttgagatcctaaaagattaatgttttacagtgcaccccttttactacaaaggggtgtctccatgaacagtcaaaatctttatcaaaggtacatcgttaacattgtatctattacccagattctctttcctaagagaaaatagtggatggttaggagaaaaggatatggtatccatacttcctagtttttatgtgacacttctttttatacctattatcttggtgtagttattaacagctctctctttcatactcaaatctatcactcttggtttggacaccctaagttattgggtgtattgagtttttaatttggttaaactatgctgatggggtaaagtgaagcagaaatgggaaaaggtggagtggctgttttcttttgcttacattcttccagctagtccaagaaattttttacagacagggtctcattgggtcacccaggctggagagctgtggcaggtcctcactgcaggagctcactgcagcctccaactcctggtctcaagcaatcctcttgcttcagcctccacagctgaggattacaggtgtgtgcctctgcagtgagctccaagagatatttggaaagagaatgattgaacggctttcccaggattgcataaagttagaagcccaatgttttatcacattaatttttatttcaattgaacaattgtgtattatactgcataattgacagacttgggttaagtctcattccattgctcaggttggagtgcagtgcagtggcactatcatggctcaagcaatcctcttacctcagcctcttaagtagctgggacttcaggcgagcaccactgtgcctggctaattaaaagaaaaaaattttttttttgtagcaacaaggtctcaccatgtttcctaggattgggttaatcttgttgtaagccagtgtttggctttcctgctcaagaacactaataattggacacgtacttattctgagaatgttaatatattttagtctttgcttctatcttctttccattataagctatgaacttagaagatctggtcaggcattgaggaaaaaagaagaaaaaaaatcaagaaatgactttctactgggaagcaataatttaaattactgtgtttaagttactgtttagaaggggaggtacaaataaattggcacatgcaaattatatgcaaacacattttgtcttctcaatttaaggtcccataatttgaattaaaatgttcttttaaagacgattgtgtagtcctaatgttctgtaacagcaaaccaaaatttggattctgtaaggagaaacttagcgttataaacaaaattccatacttgggattttgctaaagtttgcactaaacaagttgcatcttatgtagttgatatgtgaaatgtttgtgttttgatgataaactcaatgcgatttttggtgttaaaattggtgtttcatggtggtcatagtaatgagtcatagtttctgagtagacttaacttttactttcattttggcaaacaaatggttatagatttacagttatgtgaatagattgttctcatgctaagtgcaaagggagtaatacttgaagaaaatctttgcctaatttatatatgtaatattttatacatatctaatatatataaaaaacccatcaaggctggatgaatatcaaaaaattcttctgacttacactttgttaaaatatacataaatttatcagcagcttccatattcttcctctaccccttcaataaaaggggcattgaagggattatattaaactggcttctgtttcctaaagagaaaggtatattgtaaagaaatgaaattggttgttgttcatttctctattgagaaaagtaacttgaggccacaactgaagtgaattaatgctgttattattgtggagcttgcattacttcttattgctaagtctgagtgaggaaagtgggaagcaatgcctttcacaaaagcataaaagtaaaatgtgactatatgtaaaaaaaagaataggctgaggggcaaaccaaaaaaaaaatcacaaagattcattcatttatatgacttactaagctgacaatttgtaatgggtattggcattagtatgtgcaattacttctttacttccaccaaactgaaactattccccccacaggaaggtttagaggaaggtgtttcagggtgggggagtggaagtggtgaaaaaaagacaaaagagcttatcctgaatctattagctctaatgaacaggtactaagaagcagacactgccacataacataaattacaatctaaatgagatatccatatttacataagcagttccttaggcgctctaagctaagttcatgggaagaaagttttccaaatgccattcataccaccagggataattgcagcactagaaagaagcatccatgccattgctggggaaacagagaatggggttttaattttcagtttgacttacatgctgttgtcatatcatggagactacagttgcagttttacagcatggtttttcttggcttattttagaatcacagaaagagtaagcttgcaaatcttttaataaggcaattacattcagacaaagattagatctcagtggcacaatagatttttgctatattattcagtatctttttgatattccactgtcactagacaaagctgtgaatagtaatgtgacaagtctattcagaagacaacaatgagggtttccttaattgtgttcacttgcatgccacacaaaccctcacttaatttttttttgcctgttttgaaaaagcagaaagaaaataccatttaggtcacaaaaaacactgttgaatctatctttgaaatctgcattttgtatttgtaagattaaaatgttgagatagtcaatcatttaattttttatttggtaaaaatatctaatgattcaaaatgtcagtcttaatatagaaatgaattacttggtataaaaagaacaaaaatccataagaatctaaagacttgtttcaaaataagtgctttggatgatgtgggatgtgaaaatggaaaatccatgtgttagtttctaatggttgctaatgaagagaaacttaaaatgaatgtaattattttatttattttcttaaaggcttgtccttccccctcacaacttaaaattccataaaatatattactatagaaatataagctatatggttatgtttagaaaatgcaattttacattaatgtatcagtttgtgagaaggaaatcatgtttatatgagctagcattttgttaattttataaattattattcatatatttattttaaaaaattggatataatggcacctattttaattttcccaagttgaaattcattagctaaaacttcatttaacttacagttcattgtttgaaactaatgagtttatagaggtaattatccttaaatgctaactcaagcaggacaaatggagactgatctaatgaagaaagaattgagttctaatcttgatcctacaagtaaattttacatcttggtttcatttaatctttttgtatctatttcctcaagagtaaaacaggggaaatgtctgatgtgaggatagaatagaaaactaataagaaaattcctgcatatataaaagcgctacactaaggtcctataatattaggatagatatagaagatcctggaaggtcctatattcacaaatttgggagattcacctactgaatcatggaaataaataagaaggagaataagattgtacaccaatggttactctcaaagagacagaaataaaaaaatgactctaaaattttctaatgtcttagaaaataattgttaaattatatgatgaaatagaacttaattattctgagcagcatttaccatttttaaacacttttaaaaagttaatttgatattactagcagaagtgatcgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtacattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatcgtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcctctagattttctagtttatttgcgtagaggtgtttgtagtattctctgatggtagtttgtatttctgtgggatcggtggtgatatcccctttatcattttttattgtgtctacttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaattgccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttctttagcagaagtgatcaataaaactttctggtcactgaaaagcactgcaaggcattttggtgtttttgcataaaaactaaagagaatacttagagcaaatgtaataagtaagatatgaattaactttttctaattaattgagatgtttgcacaaacactaattgcaatgattagatgtcttgagaactatataccttgatattgctacagaaatctgcccttctatgtgcttaccaacagtttatcattttaatgagcttgtccaatagagctcagatcacaatatagacttacatttggtgcttccaaaaattattaagaaaataaaaacaatactttatgattgttaattatgtgggcaaattaatattcacaatcctgcaaatccaaatattgagtttttaaaaagtgtttccctattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagatcacatggacacaggaaggggaatatcacactctggggactgttgtggggtgggggcaggggggagggatagcatcgggagagatacctaatgctagatgacgagttagtgggtgcagcgcaccagcatggcacatgtatacatatgtaactaacctgcacaatgtgcacgtgtaccctaaaacttaaaaaaaaaaaaaaaaaaaagtgtttccctaatgtaattcaggtcatccaaaacagtccctcacaagatctaagtttatcttgctggtgttcttaatacagatttgtcatggacattaaaatcccacacaaaatgtttgatacttactatggaaaatcttaaatgtgatttttcagcattatattctacctctacagattctaatgaatgaataaattctttattgactttggctcaagtggcaaggctatgtgactcagggaataaccaagtgttggcagaacaaaagtgaaaaatcaatagcaattgattatttaaactcggaatttcagggtactcaggcaggatttattctaagccaagccccagtaggaacactctttgaatctatctgatttgtaaactgtctccaatactttttcctatatagttaatttgcaatcagaattgctgttttaaactagggcatctaatgtattggtgaatgttatatagttcctgtaatttatttatttttgttcatatatgtgtcagtgtctacctatgtcccattactttttttccttttgacttctgacccttctcttgagatgtttcttctttatattattttatttcagaaactgctagaattccttcaggactccagtacccctgtggtgttgtcatatcgaattgtcagggcgggggtggggggtgttacccatctgatctcagccaaatcaggatgggacatcattcaactgaaagccaagagggacacaattggaaagcagtgcaccatgctttttgtatattgcacctgtctcttgggtggcatgctaaaagtagcagcactttcagaaagagaaaagctggcagatgttggcggtgattaaagggatgattaaaaactggcacactctctccatgaaagtgtgtctgtgtttattcaactacacttagaacttggcaggtcttggagatctggccagactggcaaagctctggcaggaccactgttactcatagtttcttcttccaagatacaaggatcagatactaagcaattaaatttaccaaaataatatataatgtcataaatataatttttgtatgaactaagtagtatataaggaagttactttcacaatatggttattgaatattacaaacactaatacttagagatgtagaattctatgataccattaattcataggtttgtaaatatttgggtgtttgcatggaaacaatttttgtgtataaaataatttaaaattgaaaatgcataagtaaaatatttggcttcttacaatcatgattacactttttttctaggagaatctgccgttaatatagccattatagagattttcaacacaattatccatgagacactttgttaaggcaaatgagaaacaagatatgtactgaccgttctgaaaacataaaatgaaacggcttacaaaagtttgcaagaatgattcatcaatagatagttttgggttttcaattattattgggagtataaaggcacataaagtataagcaaattctttatgtgaacttgtgaattactaatagtaaattagaagttgatgagtcactttacaaatatctaattggggagaaataatatattattgccacatacatgattgccagtgaaaaatatagactaatattattattgaatgcaaagggatctttgaattcaacctttcttccaatttttgaattctttatccaacatccttgataaatagtcatttaatatttttgctgtcagctatgttttttttttttttgccacctccagccatgaaacccattggatttctctattgccaacacatttctatgcctttggcctactgtttctcctgtctggacttctttcctcccctgcaatttccaaaatattatttgcctggcaatatgaaatgcttccttctccgtgaagaggctttcccagttctgtcaaggtagctaaaaacatcttttgttctctactgttgttatggcatttgccatactatattgctattataatgtacacacacataaaaatatttgtaactctcactttaaaatgcttgtggtcagcaatggtaaaattcatttgtatatttttggaacttagcttatagtcccctcccaataagtatttttttgactacacgtgtgaattaatgaataattttaattggaccagaaagaacagtcacaaaattacataagcaagaattaaaataaaatacttgagctcataagatttagaaaaggtactgacatagatgagctattgctgaaacaaccagtattatctcattttcattttttaaaagagctatattaaccaatgatggccccaggtaactgagtgaagtgagcctagagacaagtataatgaagagttttcacattgctgagaagaatcaaaagtggacaagaaacaaatgttgatgtcctgtagcatgctgttgaaattcatgtcttttgtcatgctggtaccctctcagcaaatgataaaatcctcaaaatgataaaacttggatttctggcaagcacccattgtttgccattattgtccatcttgataatagaaataaagctgtaagatttcgctgaaatcagtatattattactttttccaacgtagctataagtggaacgaaggttaatacatttgctaagtttctttcattgtgaagttattagagtatgttcattttgtaactgttgttttataacaaaacaaacacataggaacacatacaaaggattttttgctccttagttcagctaaaatctgggttcttgtctcatgaccaggaaaagttaggcacatggacgcactgaagggtgaggagagcagaatttattaaaataaagctgtctgtgaaaaaaacggcatcctgccagcaagctcccacctcacagatagaataccagaccaccacacatgagctgaagcggctgggatcctcctgctgcataaggcacaagttccctgtggctccaccccattctcccagtgcacaggcaggcccttattctgagtcactccacactggtttacttctcttactgcacatgtgttaagggatggaatttttcaccttgggcatgtttaggcaagccccctgtgcagaatgaccccgtgtggcatttggctgtctcctgcctctatcattcccctctctaaataagtacatctaactgccattagaacaaggataaggttataagggcaaataccaatcgtaactgattcctgctgacagggatgctgttttgtgaaaacagtagtcagatctccttcagaagcctatttaagggttcccagcaaaaggagccactgtctgagactccgttgcatgactgtttggagtttgatggtctgaaggcaagaagagataaattgggttattagaaaacatgtatcaaaaatcctaaagccttttactagtttgcatggagagagggaggccaaaagcctgactggtaaaaacaaacaaacaaacaacaacaacaacaacaacaacaacaacaaaaactttgcccttttgacagcatgttgggcttctggccccgagcccaatcctaagacaaccagtttaaggtttgggaaattaacttttcccagtttgaaggatgcatctgatgggagtgtcctgtagtacagagacacaactacctatctgtgaagagaggaaagaggaggaaaaaggaaaaaagaaggcattattttcaaaggcatcacagtggttcaggatgcattcaaaaggggtacagactgaagatgaatggctactcatctagaaagggggtggcggggcatcccaggttcccttctcttcctagcaaatacccaaggtacatgagggagagaaagtgaggcatccctctttctttcttccatccttatatccctgagtcccagcaaccacaacagggtaccacccatgggtgtcaaagcagctttcacccatgtcaacaagggggcatagggggtgggaatatccactcttactcatttatgccctatctctcctgctgtcagtagcctttgagttccctagaactcatttttaccatggatactagcatgacctttatccatgaaatgagaggcttggcttaatcggcaggaattagtgatgctcacctgcactgtgccttttaacttcattattgtctgcctctgcatccctcagatccagttttctttcctagggcttcaactaaaagcttggaattgagtttgggaccaaaaatctgtcttggggaggtttcttggactccttatcataagctgaatgctaaagtgaagctgtggaattaagtcctcctccaacaagggacccaaaaaggaaacatttgggcatcctatttatttccatcacccaggaggatttgcaggataattgcccagaactagaatattgatccagagtttttcattttccatcccctcttactcttttttttttttttttttttttgagatgaattctcactctgtcacccaggctggagtgcagtggcaccatctcagctcactgcaacctctgcctcccgagttcaagcaattctcatgcctcagcctcccaagtagctgaggttacaggcatgcacctccacacccatctaatttttgtatttttagtagagaagggatttcaccaagttggccaggctggtcttgaactcttgacctctcaggtgatccacctgccttggcctcccaaagtgttgggattacaggcatgaaccactgtgcccagccctcccttttgttccttctgagctgtagacagagatcgcagattggttcataggaataagcagggttagtctataatgtaggcaaaaacttaaaaacaactaagcagtctagaatttaatgataataagttttgaaacataatttctctagtcatttttgttaaaaaaatcatgataggactgagttgcttgcaaaatagactttagtcttatacttagcctgattatttacataaagtgcagcaagaataattagttttacatatgccttttagattggctttgatggaactctgttccacaaggagtctcagataggactttctaaagccgagcccacccatgggtttgtaccctcaaacatctgtgagtgggtaaactcttttcttgaggtcccaagagcatggggttcttgggcctgttagaaagtgacattctttacttaccacaggttaggaacccagtatgaagactgtgtagacaaggtatgaggccagttttcccaagggacttttattggctctgcaagttgagcttgactccttaaagggaagcataccttttcatcaaagccttggtaaaacaaccagtttctccaactgcatccttttgcaaaagaaaatgggttgttattgcactgatgcaagcaactatattgccataagttaagaatactcaactagtttctaaattctgcagaagccagggagagagagagaaaaaaaaatgttccaaattttgttcacagaagtatatcttactcaattattaaaggctgtaaatagctcaaaataaatttccttgactctgaaaaacagaacaaggatcagcaatgttccaagcaaaaatcaaaaaattacttcagctttctattagttcagtctgtttagttaactgttgttttgcttaatatttatgaacatatcagctcttcatgagtcctgtacatttttttctctattccaatgtcacagtctccaaagttatcagaaacctgcatttgagagcacttgtcaaagttctatagctggttataaaccatcttttgaagaggatcaaaacaatacaattgtgaataacaaaatgtctggggtagttacagtcagagacatgattgacaaagaaagttggttatctgtatggtttaaaataacataacaaccctaattgtgattgatagcatatattcagccataagaattttagaaatcccatacaattttggaacatacattattattccctaaaatataacctgatgaagattaaacatcattttggcaatcccatgtacctaaacacgtcagacagtcctgtttacctctcttctggatgctccagaggccctctgaagcatccaaaagctagggttcaggaaagacaacctcgaagctaaaatgtaattttgggaagcctgttaaatgttagaggtttaaaacacttgatgttatgaaatagaatcccagattaccataagttattttgccaaaatgataactcaaaaatttaaaaaagcaaaaagcttttataacacttttgaatttagtcaatgttcacacacagaatttctttggcaaggttaattatttagaaaccttccacaacttctttgagcgtttggctttatcttatctaattcaaaccaatcctttaaccctaggcaaaaatttatattttgactacatctgcattttactaataatctttaaggctttttatttctcagagattaaaatcttgtaaaccaaaagatatcacagcttttatgttctctttaaaaaatatttgatttaagcatttatttttctttcaagccagttaattagagctcttttttgtagacatcacacacaacacatatataactacacaaactcacagaagaagatcgaagagctataagagtttttttatttgctaatctcctaactggactattggcctctgggtggagacctgtaagagcaaatctaggaaagcatgcactctctagggcctgctaaacaggtatagctgaaacacaaaaacagattttgagagggatccatctgcctccaattcgtgggactccctgaggaaaacagaggtctctctcaaaatggaatctgtggtggcttttctgttttttttcaaggagtcccaagccatcagaaattatcttagggccccttatgcttgcatttagagtgacaagatgaaatggagaaaaataattcagttgactgagaaaaaaatccttcttccagcaaaacaagatccaagaagggaaaacataaaggccttttaaatatacctataacttggatatccacttttaattaagctgaacactctttaagaaaattcttttaaatcccttgttacatgactttagctgcaccaagcagccagtatttctggctttcaaactttactgaaggtaaccacccaggtactcagagaaaggaaaattcaaggcagttcatggagtagaagagaataaacaaatggcaaaggtcacacagatatcaaaccacaaaggactcattccctaagccaggattgaacccaggccaccattgtaaaatagtggaggctaaaacaaagcattgccacatggttctcccaaggacgtaaaacaagatagaagcttgcagcaaagtttgctactgaccagttagccaggctggcttgaacagtgggtctatggagtcctaggcccacatcccatccttagatacccctctttctgacagaaccatactaaagccatccaaagcatcgccagattggctacagcttaagaccaatctcacaaatccatttttgtaagtaaaactttacaaagaatgtaaacagtgatagttgggttcctggcctagtaaaacgtccttgaaaaggaaagaatagcctcttgcataaaagttagctcctgacctaatggagaaaaggaaaagaaaaacagcttaaatgcagggctagaaagataccttggggaagaacctcttattcttatgcaaatgggtttttccaacagggagagaaacttttaattgccattggatggagatggactcctcggctggaggaggggaaggcaccatgcatgcgtggcagggaatgctggccagccagccaagcggggacttgggccatgcgccatagccccaggtaggagggtaggggggtgggagtcaccactcgcctgtctatccagtgtgcgtgactgcagccactggggtggggttagaacacccccaatattgtaaaggaaaaaatagatgccatacagtcccaacaggaaagatagaaaatgccacagaaaagactgggttggattgaggccgacattcctgaatccgaagagtgacagtagggggttggtggggtggggtgcagtttcctctaccctcagaagaagtctgaggacaggaaggctcagaaacgagggataaagattttttggtctgcattttactcacctttcctcgttccccaaacaggctaccaaaatgatgcaggatttttttttttttgcttctcagctcagctaaaatctgagttcctgtctcatgaccaggaaaaattaggcacacagacaaattgaaagttgaggagagtagaatttattaaaagaaagctctcagcaaagaaagggggtcctgccaacaggctctcacctcacatattgaatatcagaccaccacacaggagctgaagaggacaggcttctccctgcataaagagtgaattcctggtgtctccaccctgttctcccagtgtacatacaggtgggtccttagtctgagccattccacattgatttatttcccttactgcatatgtgttaggaaatgaaatttttcaccttgggtatgtttaagcaagcctcctgtgcacagtgccctggttggcatttggctgtctcccgtctctctcgcaagcacacacgatgacttgagatgatgcatatattcaaggaatggatattataaaaataaaaattattaatctgggccatgttcacacttctgttgctctttatttccttgactgggggaagttttcttaattttatttcagccattatggcctttcatgcatttcaattttgagcctaatacttttaatgaatgttctatcttggttaatattttcacagaatgctgttttcagtaaattttacataatgcagcttatcagctaatgtttcaaaatataacatttttgttatattgctatcattgagtgggtaccactcaagaattttaaacaggagataaatttactgctatttattttctctgtcttttttttttttttttttttttttgagacgaagtcttgctctgttgctaggctggagtgcagtggcacgatcttgactcactgaaatctctgactccctgggtcaaatgattctcctgcctcagtctcccaagcagctgggattacaggcacctgccaccacacccagctaatttttgtatttttagtagagacggggtttcaccatgttagccaggatggtctctatttcttgacctcatgatctgcccaccttggcttcccaaagtgctgggattacaggcattagccactgcacctggcctcttttagacagcactagtttacagatcaagatctattctcaaatatctaactatatgtttatatatttatactgtttgtgtatttatattttcaagtagtttttccaggaatattgaagcagagagaaataattatgtaatgaatctctgaggttcagttgaaaaacaaaagtaagagaaagcatctttatgattttaaaaaatgatctttatctcaagagcaagtgaatgagactgtagtcatgaataaaatgtaaaatttcaaaaagatttataaataaaataaatgttggaatttggaattctaagggatggaaagaataacaaataatgaaaataaaaatttcaataaaatgtcaacaaatgggaagtaatagatagtattaggtaaaaagaatttcaaggaacatttagaaaatcacacacatacacaaatatatgaggttgcataggagacattcaggggtactgctagttgaatcaaaattttaaaaccttgaaaaatgagacatgtataagaattataccaaagcaggatgacttgaaggacttaaactcagaaagtcaaaattagaaggtagctgcaactaataactgacaagatgtcaaggtatggagtaattaacctctagagatatcttccaattcaaccaatagctattttttttaaatactataaaggtccttgttcactgaatgtcgtgtgttattatgaataaatctgacacagttctgtagaactcaagaggtttttgtgttgtttttgtttttgagacagagtctcgctctgtcacccaggctggagtgcagtggcatgatctcagctctctgcaatctccacctcctggattcaagcacttcctgtgcctcagcctcctgagtagctgggattacaggcatgcaccaccatgccagcctaatttttgtatttttattagagactgggttttgctatgttggccaggctggtcccaaactcctgagctgaagtgatcctcccacctcggcctcccaaaatactgagattagaggtgtgagccaccacccctagcctaagaggtgttttttaaacactcttcaaaatacagtcgacaggcttcttcttaaaaataaaatagattatagatgtattctttaaggaagcaggagagatctagtgcttatttccacaactgcattcctgctatgtctactctcttttgaaagaatgtgtgcagtgagttagattttgtgctagaaatgccaaaggtgaaaaatagaaaaatattatacaagttaaggattatatgtatatattcatttcttcaacaatgatttattaaataactatttcttccaggcactgttctaggcattgaagatacagaagtaacctaaatggatattaacttttctcatggtgttccggtgtgggaagacagacaataataatacaaaagagtgaatatgtgtcagagtgtgaagagagttttggagaaaaaagacagagttggtagatagtactggggttgctattttagacaggatgatcaggaaaaatctctttaatttggtgaaaattaagcaaacaccaaaatgcaatgaggtggctatgttggggaaaatgtaaattacaatttataaaatgcattacaaagtgtattattttatttgagttctacaacaactgtaggaagctagatatatattattatcattcttaatcttgtggaaactacagttaagagagggcaagggagttgaagttacctgcctagtagagaggggtgttatatttaatccaagtcaaatattactagttcagcaacaggtcttgacaaaattgcttactttctctaagcctcagtcacctaattattaagatggggataatagtaatagtgaccccatagagttgtgacaattgtaagatgatctgtataaatcaatttagtgtttggcataggcgtctgacaagccttgactctagatcaggggtcagcaaactattgccctcaggccatagccggtctgctgtctgtttttgtaaaacatgcgagctaagaatggtttttacattttaaatggttggaaaaaccaaaagaacattatgtggacttcaaatatcattgtccataaataaagttttattggaacacagtcattctcattcatttatgtttgtctaaagctgttttatgctacaacagcaaaattgaggagttataacagagaccatatagctggcaaagctgaaaatttgctaactgaccctttacagaaaaattttactgatccctactctggatagaagtgctcaactttgctgcccaagctatgtgttgtttctttttatttcatttatttttatattattttatttttaataagcatataataattttacatattttgggggtacctagttatgttgtgatatgtaccacgcacagtgatcagatcagggtaactggcgtatccatcatctcaaacatttattgtttctttgtgttgggataattcaatatcctccttctagctatttaaaactatatattattgttaactataattgtcctatagtgctatagaacactataaattattcctcctacttgtctgtaaatttgtattcttcaacaaatctcttcctatccccaactcccaccacccttcccagcctctagtatcctttgttctactttttacccctttgagatcaacatttttttttagctcccacatgtgaatgagaacatatagtgtttaaatttctgttcctggcttattttacttaacaaaatgcctcccagtaccatacaagttgccacaaatgacaggatttcattcttttttatggctaaatagaattccattgtgtttatataccaccttttctttgtccattcatctgtggttggacacctacctcaaggctgattccatatcttgattattgtgaatagtgctggaataaacatgggagtgtgtatatctcttggatatactgatctcctttctttcggataaatgcccagtagtgggattgttagatcatatggtagttcaacttgtagtttcttaagaaacctccatatgtttcttcatagtggttgtactagtttacatcacatcaacagtgtataagagttcccttttctttgcatatgtcttgccctttcaagtctgcaaagaggtctgcctataccacctaatctaaagtagttccttccatcccaatctcacctcttaatttctttccattgctatgttttattttcatcaatgcactcactagtgtctgaaattatcctatttattttgtgcttgtttatcagtttccttcccacttgatgaaatgctctgcttgtgtaaaaaatccatctgacatcttgtcagttagagttttaggatatatttatgttttgcctatatgtctttggtcttatttctcagtttcctatgaactctgaatggtaaagaggtgttgttgatagattctgctcaaaatctctagaaacatgtatagattgtttcttttgaagaatgggactatactctagatcttatttgactttattttctctctttattttaccttgtttgtacatataactccctatttttttttttttttttttgacacagaatctcactctgtcactcaggctggagtgcagaggcacaatcacaattcactatagcctctacctcctggctcaagtgatcctcccacgttagcctctccagtagctaggattacaggtatgtgccactgttccccactaatttttgtattttttgtagagacagggtttcaccatgttacgcaggctggaacttcctattattttaataactccaatatatagataaaattagtttaactattatcatttggatggaaatttgtaataatttattattacaaacagtgatacaatgagtattttgttattttgttcatttgtgcaagtatttctgcagaatagtattatatgtaaatattatctcaagaaatatgcctattttaaagtttatagatgttgaaaaattgctttctaaagagctgtgtgaatttttatgctccttaacagcacctcttccccatatcttaactaacactggatattgtaaagatttttcatttcaggccaatctggtatgtaaaatgtgatactgcattactattttaattttttcattgaatatatatgactggacatatttgcttaggtgtggtggtcatttgtattcctttttctgtaaattaccattcatatcattactcctcaaaaatgttgaattgtcctttgttaaaattgatttttatgagttctttaaaaaattttgacattatttctttttaatctcatgtatgttttaaatatttcccatttgtctattaattatctttgagttttgcttctggtgtcttgtagccaaatctatcagctttttctttgtggctgttagattttaagccttgaagaacttcttcactcaaaaattataaaaatatttctccatattttcttctagtaattttataaatttttaatgttcagctctttcatctatccaattttgcctaatgtaattgatctaaattaaattttcccttaatagttatctgccgcaatattatttactgagttgccattttttaaaaactacttatttgaaatgttaacatctaaaaacatatgcagttattccttgattatatttttttaagtaaaaaaattaaaattaaagaacggaataaatacaaaagtacacaaattgtgaacaaaaacttgattaatttacaaagcaaacacaccatgtaactatcagctatgtcaaggaatgaaattattactatctcagaaaactgtattctgtaggtagtccattgtatcttcaaatattgataattctgtcttttagaaatatattttaattttgctcctactatgttaggaaggtctccagaaatatacaaggacctctttctcttgttcctgctttaaatggggaatgcttttgatcttttattattaaacatgagatttcctgtaggttcttggtagattctccccaataaagtacagaaaaatgtttttgtattccaaatttataaagataaaaaaacatgcataggagctgaatttttgtaaggcaacaatcagaattgcctgaaggtgaccttataggctcaggctggcttgcttgaacatcaggctagctgggacaacaacatttctcctacaacagtaggagaaaattcactgaaattcagctttcaccctctctctgccccacctttgaaggagaaactaaaacatctcacctcactaatatctttactaagacaggtagctgacctactcaggcaattcctctaaactgcttttgctccaaatccagaaaaccggatgctaggcagcctgagtgctctccccacccacaagattgactctcatgattgaattatcaggaggagagatgagggtgtggaggtgatagtagaggctggcagtagacctctgggtctactgggttagcaatgctctggcttggtttgtcttcctgtgtcatgttgaaaggattaggggttaccacttacgccgtctcttcatttctggttcctggcatttataaattctccctttcccaaaaagtgtattcttcaataggtgtaacattgtagaattcatctgatactttgtgcgtagagatggtactcactcaggttagagccaccagctggggaaattacatgaatagcatctgtcatgattatcacattttaaagccaatttgttaatgaattgcattatattaatagatatattactgcttaacttttctttcttgtgataaacgctaacatgatttaatgctagtctgattcaccagtatttatttatcattataaaaatctctattaatgagtaggaggactttatagttttttttgtaaataattttgacacaattttggggaggcttttcatctttatttctgtgctccgaataaatttaaataacaaggagttatctgttctttttgaatttagcaaaactgactagtaaaactgggtatgtgcattttgtagagagggtagatattgatatgctttcaatatgttttttcactactgtctaatttaggcttcctatttttaaactcaaaattagtagtttaagctttcctgggaaattttctataattatccacttcatctaatttccccttcccccaacccattacaatatatatatttttttttttttgagaaggagtctcgctcagttgcccaggttggagtgcagtggcacaatctcggctctctgcaagctccgcctcctgggttcatgccattctcctgcctcagcctcccaagtagctgggactataggtgccggccaccacgcccggctagttttttgtatttttagtagagatggggtttcaccatgttagccaggatggtcttgatctcctgacctggtgatctgcccacctcggcctcccaaagtgctgggattacaggcgtgagccactagaataaatttttatgttattgtctttaactttaaaaaatatgacccaatattccctttcttgttctgaatttattattaatagcttttgtataaaaagactttccaaagtttctgtttctaaagaactagtttaggaatttgtttttataggcatgctttattttgttgaatttcgtagatgttgcgttttttatacagtgaaggattgaggcacttctgcatctagcaggtctattggcatcatttctgcaacagcgtgtactcacttgtgtctctgtgtcacatttggtatgctatggtgatctgtgatcagtgatctttgatgttattgcaattattttggggtgccatgaaccattcccatgtagtatggtgaacttaattaataaatgtgtgtgttctgactgctccactaactggctgtttctctgtttctcttcctccccttgggcctttctattccttgagacacaataatattgaaattagaccaattaataaccctgcaatggcctctcggtgttcaagagaaaggaagagttatacatctctcccttgatattgaaagctggaaataatgaaccttggtgaggaaggcatgttaaatggctgagataggctgaaagctaggtcactcatgccaaagagttagctaagttgtaaatgcaaaggaaaattcttagatgaaaattaaaagtgctagtctaatgaacagatgaatgataagaaagtgaaacaaccttgttgctaatatggagaaagttttagtggtctggatagaagatcaaatcagcacagcattcacttaagccaaagtctaatccagagcaggaacctaagtctcttcaattctgtgaagactgagagggtaaggaagctgtagaggaaaagtttgaagttagcagaggttggctcatgaggtttaaggaaagaagccatgtccataacataaaagtgcaaggagaaacagcaagtgcttttttgtagaagctgccataagttatccagaagatttagctaagatcattgatgaaggtggctgcatacactaaacaacagaatttcaaagtagacgaaacagccttctattggaagaagatgctatccagcactttgatagctagagaggagaagtcaatgtgtggcttcaaagcttcaaaggataggctgactctcttgttaggggataatgtagctggtgacatcaagttgaagccattgctaactgaccattctgaaaatcctaaagcccttaagaattatgctaaatctactctactgtgccctataaatggaacaacaaagcctggatgacagcacatctgtttaccatgacttgtttatttaataaagtccactgttgagacctgatgctcagaaaataggattccttttaaagtattactgctcatttgaatgtgcttggtcacccaagtactctgatgaaaatgtgtaaggagactgatgttttcctacctgataacacaacatccattttgcagcccgtgaattaaggagtaatttcaacttttaagtcttttgatttaagaaatacatttcataaggctatagctgccatagatagtgattcctctgatggatctgggcaaagtaaattgaaaacctgctggaaaggattcataattctagattccattaagaacatttgtgttaggaatgtggcaagtcatttacttcttccagtgtccttcaaggccatgaaaggactcatactgaagaacctgaggaatgtaagaaatgtggtgaagccttcggttgttccagttccctttgaaagcatgaaatttcttatatgtggttttaaaaaaccctatgaatgtaagaaatgtgttaaagctttcagatgttctaatttcactagaacacatgaaaaaactcacactggagaaaaacccaacaaatataaggaatatgagaatgtatgcaatttccccagttccctttaaaaacagaagaacctatactaggaagaaaacctcataaatgcacaaaagtggtaaagcattccattttccctgttgctttcaggtacatacaagaattcacaatagagatataccttgtaattttcagaaatgtggtaaagcctttagtttttttatttttcttgaaatcatggaaggacttagtggagaaaagccgtatgaatgtaaacatttggtaagtcctttagttgttcctgttccatttgaagatatgaaagaactcatttctgagactaaccctataaatgtatacagtgtgggaatgcttttatttctctgatatttattcaaaggtgcatgataacatatactggagattgaccttacaaataaaagcatgctgagataaaaccccagtagtttggaaaatacagggaagttttcaattgtaacaattactttaaaagttatgtgaaaactcccacgggaatggaatctcataaatataggttaattggaacttgtgatgcaaagtaattactgcataatgctaaaaatgcacataaattctatactcatcacaaatgtatcgtatttgtcagtggttcattgttgaagagggactctatacttttgattttcacttgttttgcaaggaatcatggaggtgagaattctgtagatactctataagccatagtacatgaatttaataggcagtggttttattctcatcagttaataaaatgtttgtgtatccacttaaaagtgtgttagacccctaggtgagttgaaatgcatttctaatatgtaggcgtctttaattttcacgtagttgtttaattgttctgtaattaatgggccatggaaaaatgagttcttgttaattgtttgaattttcttagtggttttatgtgtcaagttttagctagtacttacccattatatatatataatatacattatatataatatataattatatatttatagatttgatttatatatataattctatatatcatatatatgatatatatatcccaccattttaatgggaaagactattttttggccgtaaaggatgtttcttcaattttctttgctaataaagagttgtgatcaattttcaaaaaaaaaaagaacactagtgattcatgggaagaggtaaaaatatgcacattaataggagtttggaacaggttgattccagctctcatggatacctttgaggggctcaatgcttcagtggaggaagtaaatgcagatgttctggaaataacaagagaactagagttcaatgttgaagcctggagatgtgactgtgactgaattgctacaatttcattataaagtttgcatgaatgaggagttgcttcttatggatgaccaaataaagtagtttcttgtgatggaatctgaagctggtgaagatactatgaacattgttgaaacgatgacaaagagcttagaaggttacctaacttatttgataattcattggcagtgtttaagagaattgactacaaatttgaaaaaagttatatgagtgaaatgctatcaaacagcatcgcaggcttcttgtattaaatgcttggtttatttattttcaactctttcttttcagttaatacctgtatttaagttgatttttttgctaagtgcttctttgctcatcacatagactttgtcagtaattccttaataattctaatttcctttttgatttcctctttaatgtaagtaatttaggagggtatttttaatctttaaagagacagattttcatttgatgtattgagtaacttgttatttgatttataatatgattctatttttctcccaagtcagtacattaagttctgcctcgttttcttaaaagttgcattgcattaagttttatagatgtatcgtaatttattaaaccagtatcatataggtagagatttagagcctttagaattttagcttgtacaaagagtgctacaaaatatttttatcaacgcttatgtgcaggtatttcttcaggaaagcaccctagaattgaaatcatagggtcaaaaacttatgtatattttacattagacagataccactcaattgggtttcaaagacttttacatatgtaccaacaacaatactgtttcctttcatcctcatcataagtaggtgtggtcaaacttctaattttctttgtgccaatcaaattatggtatggagaacaatggtccccaaagatgtccatgccctagttctgggaacatggcaaatgggactttgttgatatgattaagatatggacctttagatgggagattgtcctcattatcctatccagtagggcccaaaataatcacacaagctcttagaagcagaagagagagtcagaagaaggggtgagagaaatacagcataagaagacttgacccacaattgcaggttttaaagatggaagaaagaggctatgagccaagggatgtgctggcttctagaagctgggaatgacccctggcttacagtgagtgagaaaatcaagaccccagtcctataactacgagaaactgaaatctgccaacagcctgaataaagacaaaacatgcttccctagaataaacaggaaacatgcttccctagagcctccagaaaggaaggcagcctgccatcatcttgagagtatattgagacccatttcagacttctgatctacagaactgtaaggtaatatatttgtgttattgtaagctactaaaatgtgatgatttgttatgctagcaatggaaaatgaatacattgatgctttaattttctttccaagataagaagtaaattggagcatttaattttttatttacagtgttattgaattgtgattagaaaatgtgatctgtttgtttttgtttttaaattttatcaatatttcctatgggccctaatatgctaatgtagtttttatctcctgacaggaccctgattaacattctagtgtatgtaaatatctcaatttttatttgaaaataatacacattcaccatttatcgggtataaaatgcaacgttgctatgtggaactattaaataaaacttagttatttaaatcctttatatttttacttaatttttttcaatcacctgatctcttaaattctgaaagattttctaaattcttctataatgattgcaaatttgaaaatttatcattgtgttttttctaattgaaatgatgaaatatttgatgctaatgaaaatttcaaagcatataaatgaatagctatgactgttggttgatcttatgaactagaacattaccaactgataggctttggttgtgtccccacccaaatctcatcttgaattcccatgtgttttgggagggaccaagtgggaggtaattgaatcatgggggcaggtgtttcccttgctgttctcatgatagtgaacaagtctcacaagatctgatggttttaaaaaagggagtttccctgcacaagctctcttctcttgtctgttgccatgtgagtcatgcctttcactttgcaacatgattgtgagccctcttcagccacgtgtagctgtaaatctataaacctcattcttttgtaaattgcccagtctcaggtatgtctttatcagcagcatgaaaacggactaatataccaatactttgcaacacctctgtgacttcctgtatcttattcgtcttctttccttaagagttaatcaactattctgaatttagttttcatcatttccttgcttaaaaaaaattctatcatatatgcatttctattcctagacaatatattactcaagttttgtttgcctttgagctttaaaaactgttgtatagtcgtttctccagaaaaacagaaccaataggatatacagttgacccttgaagaagccacatataactccccatgcagttgaaaatccacacataacttttgactttgaaaaatttgggctaggtgcagtggctcatgcctgtaatcccagcactttgggaggctgaggtgggcagatcacaaggtcaggagatcgagaccatcctggctaacatggtgaaaccccctctctactaaaaatacaaaaaattagctgggcatggtggcacatgcctgtagttccagctacttggaaggctgaggcaggggaatctcttgaacctgggaggtggaggttgcagtgagctgagattgtgcccctgaactccagcatgggcgacagagtgagacttcccctccaaaataaaaaaaaaaaattgactactaatagcctaacatttatcagagccttactgaaaacatagacagtcaatgaacatatgttatgtatgttatatgtattatatagtatatcttattataaagtaagctagagaaaagaaagttttattaagaaaattataagaagagaatatgtattgactattcattaagtggaactggattgttgtattgttcttcattcttatcatcttcacattgagaaagctaaggaggaggaggagaaagctaaggaggaaagctaaggatgaggaggggacctgcacagttaaaacctgttgttcagttgtttctgaagtggttgtaatttacctctttaacagcagttgtctaacaatatatttctgtcagttcactttcttaacattcagtgtcctgaatggtattgctgaggctttcttctagggttcttatggttttaggccttacatttaagtctttaatccatcttgagctaatttttgtataaggtgtaaggaaggggtccagtttcagttttctacatatggctagccagttttccaaacaccatttattaaatagagaatcctttccccattggctgtttttgtcaggtttgtcaaaggtcagatggttgtagatgtgtggtgttatttctgaggcctctgttctgttccattgacctatatatctttttttggtaccagtaccatgctgttttggctactgtaaccttgtagtatagtttgaagtcaggtagcatgatgcctccagctttgttctttttgcttaggattgtcttggctatgcgggctcttttttggttccatatgaactttaaagtagttttttccaattctgtgaagaaagtcaatggtagcttgatggggatagcattgaatctataaattactttgggcaatatggccattttcacaatattgatttttcctacccatgagcatggaatgttttctcatttgtttgtgtcctctcttattttttgagcagtggtttgtaattcttcttgaagaggtccatcacatcccttttaagttgcttcctaggtattttattctctttgcagcaattgtgaaagggagttcactcatgatttggctctctttttgtctattattggtgtataggaatgcttgtggtttttgcacattgattttgtatcctgagacttttctgaagttgtttatcagcttaaggagattttgggctgagacaatggggttttataaatatacaatcagtcattggcaaacagagacaatttgacttcttcttttcctatgtgaatcactttatttctttctcttgctggattgccctggccagaacttccaacactatgttgaataggagtggtgtgttgcaggaagtcagggaccccaaacagagggactggctgaagccgcggcagaagtacataaatcgtgaagatttgacggacgtttattagttccccaaattaatacttttataatttcttatgcctgtctttactgcagtctctgaacataaattatgaagatttcatggacatttattacttccccaatcaataatcttataattccctacgcctgtctttactttaatctcttaatcccgtcatcttcgtaaactgaggatgtatgtcacctcaggaccatgtgatgattgtgttatctgtacaaattgtttgtaaaacgtgtgtgtttgaacaatatgaaatctgggcatcctaaaaaaagaacaggataacagtgattttcagggaacgagggagataaccataaggtctgactgcctgcggggccaggcagaacagagtcatatttctcttattgcagaaaacaaataggagaaatatcgctgaattcttttccaaggaataaccctaggaaaggaatgcattcccagcggtgggtctatggatgtctgctctgggagtgtctgtcttatgtggttgaggattagggatgaaatgcaccctggtctcctgcagtgccctcaggcttactaggattgggaaattccagcctggtgaattctagtcagaccagttgtctgctctcaaacactgtttcctgttaagatgtttatcaatgacaatgcatgcccagtgggacatggacctcatcagtaattctaattttgccctggccttgagatcttgctctgcctctctgcccttgtggtcttttattgccctttcaagcatgtgatctttgtgacttactccctgttcatacccccctccccttttgaaatccctaataaaaacttgctagttttgcagctcaaggggcatcacagaacctaccaataggtgatgtcacccctgggggcccagctgtaaaatttctctctcttgtactctttatttctcagactggccgacacttagggaaaatagaaaagaacctacattgaaatattggtggctggttcccccgatagtgccgagaaagggcctccttgtcttgtgccagttttcaaagggaatgcttccagcttttgcccatttagtgtgatattggctgtgggtttcttataaatagctgttattattttgagatactttccatcaatacctagtttattgagactttttagcatgaaggggcattggattttatcaaaggtcctttctgcatccattgagatgatcatgtggtttttgtcattggttctgtttatgtgatggattatgtttattgattgttgtatgttgaaccagccttgcatcccagggatgaagctgacttgatcgtggtggataacctttttgatgtgccgctagatttggtttgccagtattttattgaagattttcacatcaattttcatcagggatattggcctgaaattttctttttttgttgtgtctttgtcaggtttttgtatcaggatgatgctggcctcataaaatgagttagtgaggagtccctcttttcccactgtttggaatagtttcagaaggaatggtaccagcttctctttgtacctctggtagaattcagctgtgatccatctggtcctgggcttcttttttgttggtagtctaataattactgcctcaatttaggaacttgttattgttctattcagggattcaacttcttcctggtttagtcttgggagggtggatttgtccaggaatttatccatttcttctagattttgtagtttacttgcatagaggtgtttatagtattctctgatggtagtttgtatttctgtgggatcagtggtgatatcccctttatcattttttattgtgtttatttgattcttttctcttttcttctttattagtctggctagcaatctattttgttgatcttttcaaaaaaccagcttctggatttattgatttttagaagggttttcatgtctctagctccttcagttcggctctgatcttagttatttcttgtcttctgctagcttttgagtttgtttgctcttgcttctctagttcttttaattgtgatgttagggtgtcaattttaggtcttttctgctttctcctgtgggcattcagtgctataaatttccctctaaacactgctttagctgtatccaagagattttcatatgttgtatctttgttctcattggtttcaaagaacatatttatttctgccgtaatttctttatttacccagtagtcattcaggagcacgttgttcagtttccgtgtagttgtggggttttgagtgagtttcctaatcctgaattgtaatttgattgcactggggcctgagagactgtttgttatgatttctgttcttttgcatttgctgaggagtgttttacttccagttatttggtcaattttagaataagtgcagtgtggtgctgagaagaatgtacatttcgttgattggggtggagaggtctgcagatacctactatgtccactaggtccagagctgagttcaagtcctgaatattcttgttaattttctctcatcgatctgtctaatattgacagtggtttgttaaagtctctcagtgttattgtgcgggagtctatgtctctttgtaggtctccatgaccttgctttatgaatctgggtgctcctgtattgggcgcataaatatttaggatagttagctcttcttgttgaatcgatccctttaccattatataatggcctgctttgtctcttttgatctttgctggtttaaagtctgttttatcagagacaaggattgcaacccctgctttatttggctttccatttgcttggtaaatactcctccattcttttattttgagcctatatatgtccttgtatgtgagatgggtctcctgaataccacatcaatgggtcttgactctatccaattttccagtctgtgtcttttaattgggacatttagcccatttatatttaaggttaatattgttatgtgtgaatttgattctgtcattatgatgctagctggttattttgcctgttagttgatgtagtttcttcatagtgtcaatggtctttataatttggtacatttttgcagtgacagatactggttgttcctttccatgtttagtgcttccttcaggagctcttgtaaggcaggcctggtggtgacaaaatctctcagcatttgcttgtctgtaaaggattttatttgtccttcacttatgaagcttagttttgctggatatgaaattctgggttgaaaattctttaagaatggtgaatattggcccccactctcttctgtcttgtagggtttctgccaagagatccactgttagtctgatgggcttccctttgtgggtaacccgacctttctctctggctgcccttaacattttttcctttatatcaaccttggtgaatctgacgattatgtgtcttggggttgctgttctcaaggagtatctttgtggtgttctctgtatctcctgaatttgaacactggcctgccttgctaggttggggaagttctcctggatatcatcctgaagagtgttttctaatttgtttccattctccccctcattttcaagaacaccaatcaaatataggtttggccttttaacatagttccctatttcttggagactttgtttgttccttttcattctttctcctctcatgttttctttatgctttattttgttaagttgatcttcaatctctgatatcctttcttctggggctattgattctgttatgcttcacgaagttctcgtgctgtgtttttcagctccatcaggtcatttatgttcttctctaaactggttattctagttagcaattcctctaaccttttttcaaggttcttagcttctttacattgggttagaacatgctcctttagctcagaggagtttgttattacccaccttctgtcagtttgtcaaactcattctccatccagttttgttcccttgctgggaggagttgtgataatttggaggagaagaggttttctggttgttagaattttcagcctttttgtgctggcttttcctcatctttgtggatttatctacctttgttctttgatgttggtgaccttcagatgggtttttgtgtggacatcctttttgttgatgttgatgctattcctttctgtttgttagttttccttctaacagtcaggcccctctgctgtagatctgctgcagtttgctggtggtccactgcagaccctgtctgtctggtattacccgtggaggctgcagaacagcaagattgctacctgttccttcctctgggagctttgtcccagaggggcacccgccagatgccagctggagctctcttgtatgaggtgcctgttgacttctgctgggaaatgtctcccagtcaggtggcatgggggtcggtgacccacttgaggagtcagtctttcctttagcaaagctcaagcgctttgctgggatatctcttcagagcaggcaggcaggaacatttaagtctgctcaaacttcacccacagcctacccttcccccaggtgttctgtcccagggagatgggagttttatctataagcccctgactggggctgctgcctttctctcagagatgccctgcccaagaggaggaatctcgagaattagtctggctacagcagctttgctgagctgtggtttgctgcccagtttgaacttctatgtggctttgtttacactgtgaggggaaaaccgcctactcaagcctcagtaatggcagatgcccctccccccaccaaggttgagcatcccagggtgacttcagattgctgagctggcagcgagaatttcaagcccgtagatgttagcttgttgagctctgtgggggtgggatccactgagctagaccacttggctccctggcttcagcccccttcataggaaagtgaacggttctgtctcactggcactccaagtgccactggggtatgaaaataaaaactgcagctagctcggtatctgctcagttggttgaccagttttgtgcttgaaacccagtgccctggtggcataggcatctgagggaatctcctggtctgcgggttgcgaagaccatgaggaaagcatagtatcttggccggaatgcactgttcctcatggcacagtccctcagggattcccttggccaggggagggattttcctgacgccttgcgcttcccaggtcaggtgatgccttagtctgctttggcttgccctctgtgggctgcacccactgtctaaccagtcccaatgagatgagccgggtacctcagttggaaatgcagaaatcacccaccttcttcgttgatcttgctgggggttacagactggagctcttcctatttggccatcttgccagccaccccctatcttattattttcttgcgtttccttttctttctttttttcattcttaagacacagtcttgccctgttgcccaggctggagtgctatggcatgatctcagctcactgcaacctccgcttcctgggttcaagcgattctcctgcctcagccgcccaagtagctgggactacaggcacgtaccaccacgcccagctaattttttggtatttttagtagagatagggtttcaccatgttggccaggctggtcttgaactcctgacctcctgatccacccgcctcagcctcccaaagtgctgggattacaggcgtgagccgccatgcccagctctttattttcttgattgttaatgagctgagaatcttttcttgtttattggccattgatatttcctttctgcgaaatgtgttttatgcattttttccaatttcctgttgggattttggtcattgtctttctttctttttttatttatataaatttaaagggtacaattgcagttttgttacatggatatattgcatagtgtttaattctgggctttgagcgtttctattagtggaataatgtatattgtactcattaagtaatctctcattacccaccaccccaacctcccatcctctgagtctccagtgtctattattcaacactctatggccatgtgtactcattatttagctcccacttctaagtgacacacggtatttgacttttcatttctgagttgtctcacttaagataatggcctccagtttcatccacgttgctgctgaagtcataatttcattcttttttttgaccgaatagtactgcattatgtatgttattttcttacagaatttaaggtattatttatgtattttttttttctctctgtatgtattttttgctctgttgcccaggctggagtacagtggtgtgatgatggctccctgcagccttgatctcctgggttgaagccatcctcttgcctcaatctcctaagtagctgggactacaggaacgtgccacgacacgtggctaattttttaattttatttttgtagagatggggtcttgctatgttgcctaggctagcctcaaactgctgggctcaagcaatactcccaccatggcctcccaaagtgctggaatataggagtgagccactgttcacagctggtctccatatttaatattttgtttctcttaagtgtggcaaatctctttcccagtttgtgatttggactttgttttttgtttaatttattcatcttttataatttactttttaaagtcttatttcaataatcattccctacctccagatcataaaagtattctgctttatttccccccatcaaacattgataattaatttttgcaaatggtttaatcctatttcatttattttttgatatggacaatcattttttcagtaccactttttgaacagttagttttttccaggtgactgcaaagacacttctgtcaaatatcaagttttcattttttgagggtctgcttctggacaatgtattctattagactgtctatttgcccatcagagttcctatgccactctgtattaattattctagtttcaatataagttctaatatatactagggcaacactctctgcttccttctttttccttcagtctttgtccttgtcctctttcttgtcctccttttcatttttttttggttattcttaggttttaatattttcatgtaaattttaaactctatttcaagagcttttcaaattcctttaaaaatttaaaaaatcttcctggaacttgactgaaattgcattgaatcaatagataactctgtagagaattgacatcttgatgacattgagtcatgctatcctattatggaatatgatatctctatttaggtcatatttaattaaaatggtctgtataaaatattaataataactgctgtagaccgtcacatagaagtttttgtgcagacacatgtgtccagttctcttgagaatatacacaggtaagaaattgctggtccatatggcttaactatgtttaactttgagaaaccgccaaactgtttcctaagcagctgcaccattttgcactcctaccagctacgtatgaggcttttaatttctccacatggttgtcaacatttattgttatcttcttttagatcatagtcattctagtgagtgggaagtggtacatcattgtggttttaatttgtgtttacttgatgactaattttgagtatcttttgagtatatatagatatatatataacatctatatgtatatatagatatatatataacatctatatgtatatatagatatacataacatatctacatatagatatacataatatatataactgtatagatatataacagctataatatatagttgtatataacacataaatgcacacatatagacatatatatatatatatatatatgatttgcaaatgtcttctcccattctatggcttttttttttactttcttgatcacattctttgtagtataaaaaattttaatattgatggagtccacttacctatttttattaggttgtttgttcttttggtgtcatatcaaatacactattgcctaagccaagatcacaaagatttactcctgtgctttcttctaagagttttatagctttatttcctatatttataagaaatataaagttctatgatgtatactgagttaatttttatatctggtgtgaagtaggaacaatttttatcatactttaactctttagataaattttaaaaaattattttaacataatagctgatttaaaatctgtttctaatatgtctacaatctgggcttttgtagaaatagtttctgttaattattttcccccctgtgtattgctcatactttcctgcttctttgggtgccttaaatttttttggtgaaactgaacatctaaaataaataatgtggtaagtctggaaatgatagccccccatttccagggcttgttcttattggtatttgttgctgttagtttagtgacattcctgcactaattctgtagcctgtgttttttcttttaactgaccactggtgtctctgcctggtaagactgatggtcagctcatgattgaatagagatttcctaaaatgtcctgtatcagaagtctcccagcctttgctgatgggctgtgtgtgtgtgtgtttgtgtgtgtgtgttgcaaaatgtcttgaatgctccaatttgcagtctacaattctggcttagctttatctttcttcttgtgcagggactcaaagtgagccagaggtgagaaattacatgttcttaggtctttcttgggcatgtacagaaccctgcaaatatatgtggttttctagatcccagtaatatgtcagaacttttaaagctccctatgaatactttgtttcccattttttattccttttcaattttttggtcatcctcttgttagcccaactggtaaccctgccttagttagccatgaagttgaataattgccagtgatttttttttttttttgacaaataccgtgggataggtcagtttgcaaagactgacctctgagttaagtgaaataatgataaaccctgaaaatggtgcttttcaaatgctgctggtcaggtcaaatatattctttagggttagatctttagggagctccaaacctattctcccttctctaatggctactaggctgaaggttttcacagttaccatcattgtgaggctgttggtttttaaagctactgcaatgctagaaaaaggagataggattagggcaagttaaagtgccacaaaatttgctcttcttactgaattttagctgctttccttgaatgaacattcattgaattgctgcggtttttaatttacagcattttgaaaaagttgattttgataatttttgcaagtgttctttctcattgcttttatgaagagatggattttcagagttccttactctatcattctgatgacagagtatctgatatactaaatgttgatgtatttttaaatttgttgtttttgttatactcttaattttgaaaacaattaacaatgaagataatagagattgacataaataaatatgagagacatcaatatacctagcttttataattaaccaatgttaatcttcttatcattgttgtactctgttgaaatctactaataatacaaggttgtcatgattcaattatttggttgtttctgtcctaaaaagttacctatcttaagaagcacttggatcaggcgtagtggctcatgcctataatctgaatgctttgggaggctgaggcaggtagatcacgaggtcaggagttcaagatcagcctggccaagatggtgaaacccagtctttactaaaaatacaaaaactagcctggcgtggtggtgggcgcctgtaatcccagctacatgtttttaatgtccctgactttcaatcttctaatttataaaatagcaaccataacatacacctcatagggttatgttgaagattaaatgacacaatgtatgtaatgctctttcttcaatacatagtgcctataattatttaaaattgaagcagtagtttggatataatttcagttggaggaaattagcaggtgagacggtttattcatgtcagaaatttaacatcctcccacctctttcagttggttactttgaaattttccatacttcctcttcagctgtgattcttttgagggggcatcatttatttatatatttcagttccaaagcacaggaaaatatcctgttgacagcatcttcaatcaattgcacagtctacttctttcctagggccaggaagccttgggtaggttacttcttaatccaacttgagcagtagtgggcttactacttcgtgtaacatatcaattttacaaatttaccttgcatgtcagggataaacataggtgtttcacagaatgttatgtatctttccctaagtttctgtaaccactaatagatagcagtaacatcaaatgtcaaaatattaattgcttttttattccccaacatcagactgtgcagttacttagtaattggtgttaaatttatctggtagataaaatgaaaaagatattgatgttatatttcaaggggtgcttacagaaataatgaataacaaaaattaaattaagcaaaatgtacatgcaaacatttaaatcactttcgcaaatagaatttaaaacatttcacgtgatcttgctttgggattcacaataaataaatgctcagatattttacttagctatttttgaaatcctttctgtgtacttgagcaaatatttatgataaaatcacaatctttgctactcatctttaaattgccacgtgcaaaatttgggtggagtaggatacacagagaatatctatttttaaagaaagtaagaaagtgtgtggattttgttagtctaaatgttatttttcttcccaatgatgagggcatctccttagtctagccctgtgggttctggtgatgatcattcatgttatatatatatgtgtgatttgattccttggtccagtggccatttttagaagttatcaatttccctgtgttcttactttactccccatctccatttagttagtgatttaaagaaagagttattttctatcatattttttatggccgatttgaagaattttataagatccaaaatgttactgtttcttcccccaaggctgaagaaattagaatgtgagcccagaatatgtgtagaaaagaagctaattggagtagagcaccagactcaaatatcgtaggccagaatgctcacatatctgggtctataattatttggcaagtggcatctacagtgctttcactaggaaccaaagagattttgcccccaaatgtaaatgggagtgagggtaatatttgtatagggactacagtagttcagatatattgaggaaaagttcttcacatgttacttaaattttactccactcctgagactcagccattactatttttctttttttttcagacgagaacattttttttcttagagaggttaaatattttctcataagtcatatcactagtaaggatagagccaacctaggtctaccaaatacctaattccgtgtcatttttgatatattttctctttctttctttctttctttttttttttgtggtatggagtcttggtctgtcgcccaggctggagtgcagtggcacaatctcggctcactgcaacgtctgcctcctgaattcaagcgattctcctgcctcggcctcctgagtagctgggactacaggcaggctactatacctggctaatttttgtatttttagtggagatggggtttcaccatgttggccaggctggtcttgaactccagatctcagatgatccacttgcctcagcctcccaaagtgctgggattacaggtgtgagccactgcacccagcccatttttgatatattttcttgagagtagtgtaattaatgtcagattaaggaggtaaattaacacttttataaaatgaaaaatgttaagaatacttatgcattttttagcatacaagtatgtggttcagatagcgacagtgatatttttaccaaatgttcataggtaaggaaataaaattcaaacagtgctgcttttccctaattctacttcctccagtcttcaaatgtaaagaatttgatgtaatatttagttggctataaaacaaaaatccctaaatatatgttctatttctgctatgtagaatgcctgtgtttccaaatgtaaagagcctattgaacatctaacttaataagaagaaatttttttcttcatgaggacatttataattctcatgattttacagttcatttcccctacagatccagagttctcttggagtaactattgaacaagtatagtacatttatcgagtatctgcttatgcttgataatttatttgtctcatccagatccgctctacactcttctctctcttgttctgtgtcctgggaggctaacctttttataaagtgcatcagtaggatctcctgctctgtggcttcttgtgggaatttcccagtggcagtcactatcaggagaatggaggcctagagaagagtaagattggggtatttttttatttgatttgttttttgtcatggctccacagggttgtttgaatcttgcctataacagaccactgctcctagagctatagttactctattaagattccagaaacttctccctccacctttttatgcataattgcataatagcaattataacttgtaggtttcccttacaactgtccatacttttgtaaatcgtccttttattatccaatttgagtgcacaatctgtttcctaccagaagcctgactggtacacagctacatactgaaaaatgtattagcctctgtactctagacagaacagaggggtaattcttaggggagagacattactaaaaagcaaagaacagataccaggcatacgcaatgaaacataccatacaaattaacatggccaacagttccaacaattgactgtggagatggaaaaaagaaaaactggagttagtgagatttattgaatcttcaaaagtacacatttggtagagtaaaactaaatattggtagagtaaagctaaatattaaaaaatattggccaggcgtggtggctcacgcctgtaatcccagcactttgggaggccgaggcgggcggatcacgaggtcaggagatggagaccatcctggctaacacggtgaaaccccatctctactaaaaatgcaaaaaaatcagccgggcgtggtggcgggcacctgtagtcccagctactcgggaggctgaggcaggagaatggtgtgaacccgggaggcagagcttggggtgagctgagattgcaccactacactccagtctgggcgacagagtgcgactctgtctcgaaaacaacaacaacaacaacaacaacaacaacaacgaaatattgccctcagtgtacattctaagcaatttggttctcaagatataagacattccctgaaaagaatgacagaattggatcagctttgatataagcgttcagtaattgctcttagagtataatacatgggagttatttctctccctgagatactgagtgatatgatactcacggaatttgctatttgggtggtatagctttcatggaacttgacctttgagtggtactctgctttggaagtttaattctgggcgatacagcctttatagaatttaacctttgggtggtgcgttcttcgggaatttgaccctgagtggtacagttcttgtctaatttgacctgtaaagtcactggatgaattttaaatgggatatgcattacaatatatgacaaagtcacagctcaaatctaaaaaagcacttgaactccgagtttataaagaaatttaaaataataagatatacaatccaatttaaaacatagacaacaagttaaatagtttgccaaaggtgtaccaatgcaaacagggacatgaaaagatgctcaacatcattggttattagaaaaatgcaaattaaagccatattgagataccgccatagacctgctagaatgggtaaaattaaaaagattgagaataacaagtgatcgtgaggttgtgatacaactgaaagcctcttatgttggtgtccaagaatgctaaaatgatacagccactttgaaaaacagcattggcagtcttttttcttataaagataaacatatttatcatatgatttaacaattccacttctaagtatttaccaaaataaatacaaacaggtttaaacaaagacctgaactcaaatgttcagagaagctttattcataacaacccaaacctggaaacaaacgtaatgttcatcaaataacgaatggataaatactttaatattcatataatggaatgctacccagcggtaaaaaggagtgtactgcaaataccggagacaacatcataaatttcaaaagtatgatgctaagtgaataaagtcaggtataagacatcacatactgtatgattccatttatattacattctataaagacaaacttatagggaaagcaaacaaattagtgattaccagaggctagggagttgggggagcaggtgttgaccacaaaggaaaataaaggaacttttctagatgataaaaatgttctgattcttgatgatggtggttacatgactgtatatatttatcaaaactcatcaaactgtacatttaaaatagtgggccttattgtatgtaattatacttcaataaacgtgaccaaaaaaaggtagaaagttagtcagtttactctatgatagtaggtaagtgttcagttcctctctgaagttgttgatggtatattttgatattgggcatatttcagtgcaattcagcttatttgaaatttgaagcactgaaggagataagattatttacactctaaatggtatgttattggaaaagtacagtatgtgaatagagtttatttcttttgctaaaaaccttacttatttgctcttatgcaatgaaaatacctgtgtatattatgaatgatggattaagatgaagtagagaaattctaagagaggaccaaagactgagtcaagggtccatgaaaatggtaatttccaattaaggaaaataagcaattcaaacaactatatccaacaaagaccattttgcataaatttaggccaatcagacttaagagttccttttggagttacctggaagggctcggaaggcaccctcacgatgaccagattaaatttgtatttgtcctccatactccatacaatcagaggtaactaaaactaccttttttttcttaatggtgttggaggaattaatatcaaaatatcaaagaaatccttctaaggatattttttaaacagtggaaattttgaagaaaggaaacatcacaattttaaaaagataacctgcacaacgtgcacgtgtaccctaaaacttaaagtataataaaaaaaaaaaaaaagaaaagtaaaaaaaaaaaaaaaagataacctttctgcattcctgacttgtatctcacaatgccattgtgaccttattactacctaaaatcaatcctgaatagttcatttttatattttactttagtgttttacttaaagactgtcatttcccccctcgttatctgacttggtatttcttgcataaatttgttgcttgtattttatcgtcttccaggctgtttgttttgcggctagcgagttatacatttgtttcaaatgcataatgagtattttggtgtctgatctcatttcttagaaatattaaattatcttatttttgtactccatatactctatctgtgggttctctctgtggtggcattaaaacaaatgttcttaaattttgtgtgaactctgtgcgctccaaaaaggggtagtgtctccctgggcattcaaggagtttttaaggagccagttttctcagtcaagagtagttggttgtgatctaaaacatatccccacagtcaaatgtgatagtactcttgcttttcaaatgctagcattattttagaagttctaagcattagtgtttcacatgcaaatgaagattacattttatgaacgagaactcctgtgttttgaatgcctactgttgctcacatattggcacttcccctgtgtttcttgatcttcctcaaaattatatgagataggtagagaaatctaaggttgacatgtaaagtgactagcccaaatttacataacttaggaacagaggtaacgttgaacccacccctatcagactttaaacacaaggcattttcaactatatcctacagaaaatagaaaagaaaaagggaaattttcaaagtaaaagaagactatatgaaatttaagtttcctgggttgttactcttccaggattccataaaaacttttaaaagaaattaaaatcacataccttcgtacccatttgtttttaccttatatcatacccgcttcaatggatagaagaaacaacgtttcgtaaagtaagaagttctggagactttttagtggataattagtttcaaagttgcagctgaattaaaacaagattttcctgttggtaatctctctgtgtccaaaaagatgttgtgatttttatttttgatttttatgttgttttcttatatgcttccagcctttttgaaacaatagcaaacatgttgttatgcttgtatatgatcagggaaattacaaatatgtattttgctgtagtcatattctcacttatatcagtttgaagtgccttttctagtctgtgatggttataggtagtctgatcaggtcctataactattacttactgagtctagttctacatttacaccaaatatttctatgaaaagtaatgtatccaacttttgttttggttctttcttttttttttttttttgtttgttttttgagagagggtctcactctgttgcccaggttgaagtgcagtggcatgatctctgctcactgcagcctccacctcccagactgaggtgatcctcctacctcagcttcccaagtagctgagactacaggtatgtgccaccacccctggccaatttttgtatttttttgtaaaggtggggttttgccatgttgcccaggttggtcccaacttctgggctcaagtgatctccccacctctgcctcccaaagtgctggaattataggcatgaaccacagcacccaatctattttggttatttctgcaaaaccagaaacatctattaatcagaatatttttgatgttatctggcactatctactaaattacataaagaaaaactgaatttcatatcactgagaagtgggtgtattaaatgccatagattttttggatgatcatttaaagtggttgaaagcctgctgacagaatccaaaaggaacttggcaggaagatataatcttggcagattttattaaagggcacttccctcccttctttctttctccagtcaatgatataattgttacaggagagatggagattgatccacggactacctaagtagtcctttgatttatgggcttctgattacacgtagggttaaatatgtttgaaggatagtctcaaaaataaattaatgacacttctggctatttggaagagtttgaatatattcattcattcattcattcattattaagcattcacacacatattttatcttccttcaaagagtttgtaatttaatggtgagagtaagacataaatgaaaataaaaggcagaagaatagttcagtgaaagaggcatccataaatttgttaagtcagaaagaagcataacttctcagggtagagactacggaaggctttctggaagaagtcgcatttggactatgcctaacagatgataatggtggaacagggaagggtattcaagtaggagggaacagactgactgacaacatagatagcttttgggtatgtatggagaatggggagtagtgtgatttggcttgaaacaggataataaaatgggaaaataaggtgggacacttgggaagtgttgaaattctggatggagtgtgtgacaggctaaggaatttggcttttattccacaggcagttgagaaaccaattggcactaatgcagccactggagaactcagtgtaccacaaggaatttcaatagtcttgcgagaggtgttaagaagtcatttaacaaaatttatacttttttcccttgtttttttctcccctcctttttttttttcccactgatgtgctatctactgtgtcaaaagcaaactttccaagattttcaagttacatataatggcaactctaatcaattcaacataattatttactgagtttcccttatatgcaagacccattgtgtcaattttaagactttacttctcaaaacttttttacctaaaaatcccaaatgcagagaataaaacctcttaccctcaaggttttggggatagaactcccaaacaacccacagacataacattatttgaagttttttgctttatcttacgtgtgatttttcattgaactttaaactatgtaaacataatcttaaattcttgctgtaatagtattaaaggtaaggaattcctattattcctactaaaagtccttgagtaaaattgacacttaaggaagatgaacaaaatttataagtggttacttaacttttcttaaaatgtcaatttagctattggagataatcattagtcagtgattaattgaaaactgaccagacagaaaataaggacattggagtcctgaggagggaaaaaacacataacctctgcatttgtatttgaaatcccaatgctaatgtacaattatactttccattttaaaagaaaatagattttattaatactctgaatacaaatatcttgaaaattaaaatattattttgaaagggttaaagattgacatatgctaccatattaaaaagattttaatcagattgccaataaaaatttaaaagtttagtttgtaaatacaaacataaacgcattttcaccaattcttttttctagtagatctttgatttctgtccttcctgatgtcagtttctttttcagaaaaactctcttcaattttcttaatattcaaatagtattttaaaatgtttacgacagatggaactgcccctcgactttaattttagttatgaccatttactgcagttgttcccaaacttgtatttaaattgtgataagttttaatataaaactttaattattaacatggaagtgtaatcaaaacataatgtggcacaggaaagcagtttgtaggtattatatactagtatgccatttttgtttaaaatgtattgcaaatatttgggaggagtatataataaattattaacagtggttattagcatatattttctgttttttaatgagcaaaacaattttaatcactgaaacaagaaaagtatttaaaatagcacctagaatagtattttgctatgctctggtgttaggatgtttacttttgaggattttgatttcaggtgctcctatctttggagcactgatgttagattcgacctatcttcttcgtatctcctactttcaactcctttgcaaatatgtacttaggttagtattaagcttgggatttgaggggaagaacttcagcttttaaaacaaccgaactccatttgaaagaagtttgccattaatgtctccccttggttttatttatgtttacagggatgtggtcacttagcacatgtatatagggtaaatgcaaaccataatataatactagggcagatgtatgctactaccacaattcagtggaggaagttctgtgttcatagtaagtttctttcttcagaaactcaaacccttgctgtctgtccattgataagaactgataggctagtttaggtaacctaagacatacagatgcactttatttctctgaatattattttcctctttcttttcacttttaaggctcaatcctatgcctctggaatcctagtataattcctcctgtatttgtttctcaatttgttcttttgcagtagtctatccattcatgtggatgaacgtcactctggatagaggaagggcaatcccaggcaatcatacacataaaatcaaatgtccttcattttttccagagggattctggattttccacagaggatcaatgctacttctttggcatcttgttcacccaggaatgtatagcctgtgtttgctagtgatttacaaaaataaaaacaaagttttgtcccacatttcctacaaataacgttttattggttatgctttttcaaagcattgatctccttactgtgtaatgctcaactcaattcagttgaaatattacagagtttcacactctaactacctctaaatatcaatttgagggtaaaggaaaataatgaaagaatcacaatgtagtgaaaagagcacaggctttagggtcagacagatctgggtctgagttacctctcttgttcactgtatgactgtggtcaaatcatatgacccacctgagcctcagtttcctcatctgcaaagggcagattgtgataccatctacagtgaggattgacagtgcatgcagaatatctgacacatgatatggtagctactattggaatttatgaatatgaaagtattttataatttaccaagtgctttataagtgaggagttaagactctccttcttctgaaaactttccatctcgattcttctcagattcatatgcctgaagcaccaaactgcttggcatttaccaagatccataatcttgtcccctttcctttcatttattttggaactgtagttactgacttctcctcttcttttctccccacctcggcaccccggtggagctccttgtctgaattctgcttgagcactctgtatttgtttccatgcacagatgtatatgtttaagtgtgtatcttttctccccagccagcacttaacacagtatgttgctcatgatgctttgctccttactgcatgttgatactgggattcaacagaaaatatatggtccatagactttggcttggatatactggccgtcatgagggacttggaatgaacttgagagttcaatctggtttgagttctggcactgacattgaccgtctctggggacttgcttaatatctcagatttttttttttaactccagaggacacaaattagattatggttgagagaattgttaaagatctgccttgggacagagtattttcttacatatgttaatttggattcctctctgtaacctcctccccagagtagatctttctttttatattatattttaattttcttccatggtagcataacccttgtcacttgcctcacttttttctacccactcaagtgtcagcacctcacacaatttaaaaatagagatgttggggctgtttatttttatgcttgtgtgttttaggggcaagtgggtgggaacactgcatcctaaattgtcacatttcaaagaaagtcttagtgaatgtatacaagttgtaaaataaagtttttattttcctgtagtggacactatgattgcctatccggcattcattgtcccctttccttttccataaggataccctcaaattttcaggtagctgcccttccatcacatattagtctgttctcatgctgctaataaagacattcctgggactgggtaatttataaaggaaagaggtttaatggactcacggttccacatggctggcgaggcctcacatcatggcagaagacaaataaagagcaaaagggcatcttacatggcagcaggcaagagagagcatgtgcgggggaactctgctgtataaaaccatcagatctcgtgagacttattcactatcacaagcacagcatggaaaagaccgacccgcatgatttaattacctcccactgggtccctcccatgacacatgggaaatatgggagctaccattcaagatgacatttgggtggggacacagccaaaccatatcatatcacgttgtccgagtgcttgagacagggtactacaaccagactcctcggagaaggttgtgtttggtctaaggctcgtcaagctcacccttttaaaaagaattgttcaggaatataggcctagccaggcagcctgaatcagttcctccgtcaggcagggatatgggatatatatggggttggtgaatgcaatggagcagggttgtttggaactttaaggaattagttttctgacccagaagagatctgggtcttcttttagatttcaagttgtgtgaaataaagctgaaaaatgtcatagccatttttttctgtcaccaaggaagctattttgaaccaactcagaggagggaatagtgaaggggagtccagagaaataaaactgaaatactgggttcagcctaacctgaggcctaacgtgcctcatggcttgcacttaagagagcctaagccttgttatttcagtcagtttgagtcagggtttgtaatatatgcatctaaaagcttcttaacatgatatacaattttaaaactgaggtttttccctagagataaaaatgtgatctagatcagtactgtccaatactactttctgagatgatataaatgttccgtataagtgtagacactattcaaatgtagctatagaacaattaaaaagtggctagtacaattcaggaactaaatttctaattttatttagttcttcccattttattaattttattttttgttgatacataatagatgtacatatttttggatacatgtgaatatttaatacattcatgtagtttgtaaagatcaaatcagtgtaattggatagtatcaccttaaatatttgtctttatgctagaaacatttcaattactctcttctagctgttttgaaatatacaatagattactgtaaactatgcttatcctactgatctatcaaatactgtcttatttcttctatcaaactatatgtttgtacctattaatcaacctctcctcacccctcctctcctctaccctttctaacctctgataaccaccaatttactcctatcttcatgagatttgatattttagctttcctgtatcattgggaatgtgcaatatttgtctttctgtgtctggcttatttcgctttacaaccaccatttccttccatgttactgtcagtgacagaattccatactttttatggctaaataatattccgttgtgtacatataccacatattctttatccattagtccatcaatggacacttaggttgattctatattttgactgttgtgaataattctgcattaactgtgggagtgcagatatctcttagatacactgatttcctttcttttagatatataagtggtagtggaattgctagatcatatgtagatcaatttttaggtttttgagaaacctctgtactattcttcatagttgtagtaatttacattcccaccaacagtgtacaagggttcccttttttccacattctcaccagcatctgttattccctgcctttttgatacatactattttaactggttgagttgatatctcataatggttttggttttcatttcactgacggttagtgatgttgagtatttttcatgtcttctctttgagaactatctattcatcccttttgcttatttttaaaatagattggacagacataggggctcacgcctgtaatcccaacactttgggaggctgaggtgggaagatcatgaggtcaagagatcgagaccatcctggccaacatggtgaaactctgtctctactaaaaatacaaaaaattagctgggcgtggtggcatgtgcctgtagtcccagctactcaggaggttgaggcaggagaattgcttgaacccaggaggcggaggttgcagtgagctgagatcatgccactgccctccagcctggcgacagagtctcaaacaaacaaacaaacaaacaaaaaatatatatatatttatatatatataatttttattatcttttgctattgagttgtttgggttccttatacattctggttattaatcccttgtcatatgaatagtttgaaaatgttttcttgcattctgtggtggtttctttactttgctgattgtgtccattgctgtgcagaagcctttaagcttgatatgatcccatttatctatgtttgctttggttgcctgtgctttgagatcttgcccaaacagtctttgcctatatcaatgtcctggagcacttcttaatgtttctcctagtagttttatagtttaaggtattggatttaagtgtttaatccattttgatttgatttttgtgtatggtgagagatagggatttagtttcattcttctacatattgttatgcagtttctcattacatttagtgaagagactgtcctttccccattgtatgttcttggcacttttgttgaaaatgagttggctgtagtggagagaggcagagcaagatggaggaaaagaatgctccactgatcgttccctacacaaggacaacaatttatctacacgaaaaacaaaacaaacaaaacagacagacaaacaaaaaaacacctttagaagaaccagaagttagatgagccctcacagtagctagttttatctttgtatcactgagagaggcactgaagagataagaaaaacagacctgaactgccacccctccccgacccctgcagcagcagtatggtgcagagagcacagaaattgtgaggccatgaactcagtgctatcctgttagagcagaaagaaaaacctggaccaaactcagctgacgtctgcccatggagagagcattgtaacaattcctagccagaggggaatcccagcagttggaacttgagttcctgcaaaccttgccactgagggatacagtcctctctgtctgtaaatgaatttgaaaggcagtctaggacattaaatctgcaaaacttaggtgagtcctagtcctgaactaggcccagagccagtggacagtgacatactgagacagtagctgaggcggctaagggggtgctgttgtcacctcccctaacctcaggctgcacagttcagggctccaaaagcgacctcttctttttgcttgaggagaggagcgagaatactggggaggactttgtctcgagtcttggataccagctcagctacagctggatagggcaccagttagagttgcgaggcctgtgttccaaggccttgctcttgggtgacatttgtagacacaccctaggccagaagggaacatgctgtcttgaaggaaaggacccagtcatggcaacattcatcacctgcttgctaaagaatccttgtgccctgaataacaagcatcaatacccaggtactacatcaagggccttgggtgagcctctgagacttgctggcttcaggtgagactcagcacattaccagctatggtggctatggggcaaaactcctgctttggaaaagcagagggaaaagtgaaagggactttgtcttgcatcttagataccatcatgggcacagggagtagctcttggggtccccaatcccaggacttgactcttggatgacagttctggacttgccctgggccggagggaagcccactgccctgaagggtgagtcccaggccaggcagcatttaccacaagctgacttaagagtctttgggccttaaggaacatcagagggaggtagtctggcagttcttctgtggcctaaggtggtgttcactatggaatgaggctcctctgcctttggaaaggggagggaagaatgggaaggactacatcttttagcttgagtgtcagctcagtggcagtataacagaacaccaggtagagttctaaggtttttgactctagtccccgactcctggatggtacctctggacctccctggggcctgggagacctcaccatcctgaagggaaagacacaggcctgcctggctttgccaacagctaattgtggggccccagggccttgagcaaacatggaaagtagccagggagtggttacagcaagctttgggcaagacccagcgctgtgcttgcttcaggtcttacccagtggaatcatagtggtgttggccacagggatacttgttactccaccctcagatttaggtggctcaaaacagagagagagagagagagagagagagagagagagagagagactgactctatgtttgggagaaagtaagggaagaaaacaagagtttctgcctgattatcaagatagttcttctggatcttgtccaagactatcaaggtggcgcctctactagtctgcaagaaccacagtgctactgggcttggggtatcccctagagcaattatagtttggatcacaacacctaagtcatttcaaatatctggaaagccattccaagaaggatggatacaaataaacccagacagtgaagactacaataaatacctaactcttcaatgcccagacaccaaagaacatttacaagcatcaacaccatccaggaaaacatgaccttatgagatgaactaaataagagactagggaccaatcttggagaaacagatatgtgaattttcagacaaaaaattcaagtagtgttatggatgaatctcaaagataaattcaagataacacagagaaggaattcagaattctattagataaatgtaacaaagagattgaaatagttaagcagaattaagcagaaattctggagctaaacaatgcaactggcatgctgaataatgcttcagaatcctttaagagtagaatggatcaagcagaagagagaattagtgagcttgaagataagctattggaaaatacagtcagaggagacaaaaggtaaaataataaaaatcaatgatgcactcctacaggatctagaaaatagcctcaaaagggcaaatctgaattattggccttaaagaggaggtagagaaacagataggggtagaaagtttattcagagggataatatagcagagaacttcccaaacctagagaaagatatcaatatcaaagttcaacctcaaaaaagactacctcaaggcatttaataatcaaactctcaaaggtcaaggataaagaaaggatacttaaagcagcaagagaaaagaaacaaataacataaaatggagctccagtatgtctggcagcagacttttcagtggaacctttacatgccgggagagaaagttatgacatatttaaagtgctgaaggaaacaagactttcaccctagaatagtatatttggtaaaaaatatccttcatacatgaaagagaaataaagacatttccagacaaacaaatgctgagggattacatcaacaccagacctgtcctacaagaaatgcctaagggagtactttaatcagacaaaaagaagaacattaatgagcaataagtaatcacctgaaggtacaaaactcactgggaatagtaagtacagagaaaaacagaatattataacactgtaactgtgtagaaagactaaatgatgaaccaataaaaataataactagaacaacttttcaagacaaagtacaaagggtatcaattaaaaaaccaaaaagattaaaagaagaggaatgaaattaaggcatagaagttttactagttttctttttgcttgtttgtttatgtaaatagtgctgttatcaggttaaaataatcggttataagatagtattcacaagccttataatcacctcaaaccaaaaaacacaatgaagacacaaaaaataaaaggcaagaaactaaattacatcaccacagaaaatcacctttactaaaggaaaacaggaaggaaagaaagaaagaagagaagaccacaaaacaaccagaaaaaaaatcataaaatggcaggagtaagtccttacttattaatagtaacattgaatgtaaatggactaaaggtttgaatcaaaagacatagaatagctgaatgattgaaaaaacaagacccattgatctgttccctatgagaaacacacttcacctataaaaacacacactgactgaaaataaagggatggaaaaagatattccatttcaatgaaaaccaaaaaagagcaggagtcactatacttatattagacaaaatagatttcaagaccaaaactataaaaagaggactataaaaaggagaagtcactatacaatgataaaggggtcaattcagcaaggggatataacaatttaaaatacatatgcacccaacacaagcacccagatataggaagcaaatattattaaatctaaagagagaaataggccccaatacaataatatctggagactttgattccctactttcagcattggacagatcttccaggtggaaaatcatcaagaaatatccaacttattctgcactatagatcaaatggatctaatcgatatttacagaatattgtatccgatggctgcaaaatacaaattcttttccacagcacatggatcattctcaaggatagaccatatgttaggtaacaaaacaaatcttaaaacattcaacaaaattgaagtaatatcaagcgtcttctctggccacagtggaaagtaactagaaattaataacaagaggaattttggaaactatacaaatacatggaaattcaacaatatgctcctggatgaccagtgggacaatgaaggaattaagaagcaaagtgaaaaaatttttaaacaaatgataatggaaacacaacatacccaatcctatgggatacagcaaaagcagtactaaaagggaagtttatggctgtaagtgcctatatcaaaaaagaggaaacattttaaacaaacagtctagcagtgaaacttaaagaactagaaaagcaagagcaacccaaaccaaactgaaatttagtagaagaaaataaataaaaaagatcagagcagaaatcgatgaaattgaaatgaaagaaacaatacaaaagatcaattaaacaaaacgtcagttttttgaaatgctaaacaaaattgacaaaccttttgccagactaacatggacaaaagagagaagacccaaatatataaaatcagaaatcaaaaaggagacattacaaactgatactgcagaaattcaaaggatcattagtggctactatgagcaaccatatgccaataaattggaaaatctagaagaaatggacaaatttttagacacataaaacctaccaagattgaaccaggaagaaatccaaaacctaaacaggccaataactattaatgagattgaagccataataaagtctccagtaaagacacgcctgggacccaatagcttcactgatgaattgtaccaaacatttaaagaagaactactaccaatcctactcaaactcttctgaaaaatacaggaggaggggacacttccaaactcattctacaaggcattattaccctgataccaaaacaagacagacagaaaaaaaagaaaggaaaaagaaaactatatgccagaatctctgatgaatattgatgcaaacatcttcaacaaaatactaacacatcaaattcagcaatacataaggaagatcattcatcatgaccaagtgggatttatccctgggatgcaagaatggttcaacatatgcaaatcaatcaatgtaatacatcctatcaacagaatgaaggataaaaaacatatgatcatttctattgatactggaaaagcatttgataaatttcaatatctcttcatgataaaaaccctaaaaaattgggcaatgaagaaacatacctcaacataataaaagccatacatgacagacccacagctagtactgtactgaatgaggaaaaactgaaggccttgatggatgcccaccatcaccactgttgcttaacactgtattggaagtcataggtagagcagtcagacaacagaaatacgtaaagggcatccaaattagaaaggaaggagtcaaattatccttgtttgctgatgatatgatcttatatttggaaaaacctaaagactccacaataaaactattacaaattataaattcagtaaagttgcaggatgcaaactcaacatacaaaaatcagtagcagtttccgtccaagatggctgaatacaaagagctctggtctgcagctctcagcgtgatcggtgcagaagatgggtgattttggcatttccaactgaggtacctagttcatctcattgggactggttggacactgggagcagcccacaagggtgggccaaagcagggcagggcatcacctcacctgggaaatgcaaggggccgggatatttccctttcctagccaaggaagccgtgacagactgtacctggaaaaatgggacacttctgcccaaatactgtgcttttcccatggtcttagcaaccagcagaccaggagattttctcccatgcctggctcgtcgggtcccatgcccacagagccttgctcactgctagcacagtagtctgagatcaacttgcgaggctgcagcctggctgggggaggggcatccgccattgttgatgcttaaataggtgaacaaaatggccaggaagctcaaactgggcagagcccaccacagctcagcaaggcttactgcttctatagactccacctgtgtgggcagggcatagctgaacaaaaggcatcgcagaaacttctgtagacttaaatatccctgtctgacagctctaaagagggcagtggttctcccagcacagtgtttgagttctgagaacagagagacagcctcctcaagtgggtccctgaaccccgtctagcctaactgggagacacttcccagcagaggcctacagacacctcatacaggtgggtgcccctctgggacaaagcttccagaggaaggatcaggcagcaatatttgctgttctgcaatatttgctgttctgcagcctctgctggtgatacccaggcaaacagggtctggaatggacctccagcacactccaaaagacctgcagctgagggacctgactgttagaagaaaaactaacaaatagaaaggaacagcatcaacgtcaacaaaaaggacatctacacaaaaccccatctgtaggtcaccaacatcaaagacaaaaggtagatggtaccacaaagatggagaaaccagagcagaaaagccgaaaattctaaaaaacagagcgcctcttctcctccaaaggattgcagctcctctccagcaacagaacaaagctggacagagaatgactttgatgagttgacagaagtatgcttcagaaggtcagcaataacaaacttctccgagctaaaggagcatgttctaacccatcgcaaggaggcttaaaaccttgcaaaaaggttagacaaacagctaaatagaataaacagagtaaagaagaccttaaatgacctggtggagctgaaaaccatggcacgagaactttgggacacatgcagaagtttcaatagccgatttgatgaagtggaagaaagggtatcagtgattgaagttcaaattaatgaaataaagtgagaagacaagtttagagaaaaaagagtaaaaagaaacaaacaaagccttcaagaaatatgggactatatgaaaagaccaaatctacatttgattggtgtatctgaaagtgatagggagaatggaacccagttggaaaacactcttcaggatattatccaggagaacttccccaatgtaacaaggcaggccaacattcaaattcaggaaatacagagaacaccacaaagatacgcctcgagaagagcaaccccaagaacataactgtcagattcaccaaggttgaaatgaaggaaaaaatgttaagtgcagccagagagaaaggttgggttacccacaaagggaaacccatcagactaacagcagatctctcagcagaaaccctgcaagccagaggagagtgagggccaatattcaacattcttaaagaaaagaattttcaacccagaatttcatatccagccaaactaagcttcataagtgaaggagaaataaaatcctttacagacaagcaaatgctgagacattttgtcaccaccaggcctgccttacaagagctcctgaaggaagcactaaacatggaaaggaacaatcggtaccagccactgcaaaaacatgccaaattgtaaagacctttgatgctaggaagaaactgcatcaattaacagacaaaataaccagctaacatcataatgacaggatcaaattcatacataataatattaaccttaaatgtaaatgggctaaatgccccagttaaaagacacagactggaaaattggataaagagtcaagacccattggtgtgctgtattcaggaaacccatctcacgtgcagagacacacataggctcaaaataaagggatggaggaagatctatcaagcaaatggaaagcaaaaaaaagcagggctcgcaatcctagtctctgataaaacagactttcaaccaacaaagatcaaaagagacaaagaaggccattacataatgataaagggatcaattcaacaagaagagctaactatcctaaatatatatgcacccaatacaggagcacccagattcagaaagcaagtccttagagacctacaaagagacttagactcccacacaataataatgggagactttaacaccccactgtcaatgttagacagatcaacaagacagaagtttaacaaggatatccagtacttgaactcagctctgcaccaagcggacctaatagacatctacggaactctccaccccaaatcaacaaaatatacattcttctcagcaccacatcacacttattctaaaattgaccacataattggaagtaaagcactcctcagcaaatgtaaaagaacagaaatcacaacaaactgtctctcagaccacagtgcaatcaaattataactcaggattaagaaactcattcaaaaccacacaactacatggaaactgagcaacctgctcctgaataactactgggtaaataacgaaatgaaggcagaagtaaagatgttctttgaaaccaacgagaacaaagacacaacacaccagaatctctgggacacatttaaagcagtgtgtagagggaaatttatagcactaaatgcccaccagagaaagcaggaaagatctaaaattgatgtcctaacatcacaattaaaagaactagagaagcaagagtaaacacattcaaaagctagcagaaggcaagaaataactaagatcagaaaagaactgaaggagatagagacaaaaaacccttcaaaaaatcaatgaatccaggagctggttttttgaaaagatcgacaaaattgatagactgctagcaagactaataaagaagaaaagagagaagaatcaaatagatgcaataaaaaatgataaaggggatatcaccaccaatcccacaaaaatacaaactaccatcagagaatactataaacacctctatgcaaataagctagaaaatctagaagaaatggataaatttctggaaatgtacaccgtcccaagactaaaccaggaagaagttgaatctctgaatagaccaataacaggctctgaaattgaggcaataattaatagcctaccaaccaaaaaaagtccgggacgagatggattcacagccgaattctactagaggtacaaggaggagctggtacaattccttctgaaactattccaatcaatagaaaaagagggaatcctccctaactcattttatgaggccagcatcatcctgataccaaagcctggcagagacacaacagaaaagagaattttagaccaatatccctgatgaacattgatgtgaaaatcctcaataaaatactggtaaaccaaacacagcaacacatcaaaaagcctatccaccacgatcaagttggcttcatccctaggaagcaaggctggttcaacatacccaaatcaataaatataatccatcacataaactgaaccaatgacaaaaaccccatgactatctcaatagatgcagaaaagaccttcaacaaaattcaacagccctttatgctaaaaactctcaataaactaaggattgatggaacgtatctcaaaataataagagctatttatgacaaactcacagccaatatcacactgaatgggcaaaaactggaagcattccctttgaaagccagcacaagacaaggatgccctctctcaccactcgtatttaacatagtgttgaaagttctggcaaggacaatcaggcaagagaaagaaataaagagtattcaattaggaaaagagaaagtcaaattgtccctgtttgcagaagacatgattgtatgtttagaaagccccatcatctcagcccaaaatctccttaacctgataagcaacttcagcaaagactcaggatacaaaatcaatgtgcaaaaatcacaagcattcctatacactaatagcagacaaagagcaaaatcatgagtgaactcccattcacaatttctacaaagggaataaaatacctaggaatccaacttacaagggatgtgaagttcctcttcaaagagaactacaaacctctgctcaatgaaataaaagaggacacaaatggaagaacattccatgctcatggacaggaagaatcaatatcatgaaaatggccatacttcccaaggtaatttatagattcaatgtcatccccatcattgctaccaatgagtttcttctcagaattggaaaaaactactttaaagttcacatggatccgaaaaagagcctgcattgccaagacaagcctaagccaaaagaacaaagctggaggcatcatgctatctgacttcaaagtatactacaaggctgcagtaaccaaaacagcatggtagtggtaccaaaacagatatatatatatatagaccaatggaacagaacagtggcctcagaaataacaccacacatctacaaccatctgatctttgacaaacatgacaaaaataagatatggggaaaggattccctatttatgatgcttggaaaacaggctagccatatgtagaaaactgaaactggatccctttcttacaccctatacaaaaattaattcaagatggattaaagacttaaatgatagacctaaaatgatagaaaccctagaagaaaacctaggcaataccattcaggacataggcatgggcaaggacttcatgactaaaacaccaaaagcaatggcaacaaaagccaaaattgacaaatgggatctaattaaactaaagaacttctgcacagcaaaagaaactaccagcagagtgaactggcaacctacagaatgggagaaaatttttgtaatctacccatctgacaaagggctaatatctagaatccacaaagaacttaaacaaatttacaagaaaaaaaaacccatcaaaaagtgggcaaaagatatgaacagacacttctcaaaagaagacatttatgcagccaacagacacatgaaaaaatgctcatcatcactgttcataagagaaatgcaaatcaaaaccacaatgagataccatctcatgccagttagaatggcaatcattaaaaagtcaggaaacaacagatgctggagaggatgtggagaaataggaatgcttttacactgttggtgggggtgtaaattagttcaaccattgtggaagacagtgtggtgattcctcaaggatctagaactagaaataccagttgaccttgtgatccctttactgagtatataccgaaaggattataaatcctgctactataaagacacatgcacatgtatgttgggcactattcacaatagcaaagacttggagccaacccaaatctccatcaatgatagactggattaagaaagtatggcacatatatactatggaatactatgcagctataaaaaaggatgagttcatgtcctttgcatggacatggttgaagctggaaaccatcattctcagcaaactatcagaaggacagaaaaccaaataccgcacattctcactcataggtgggaattgaacaatgagaacaaggcagggaacatcacacaccagggtcagttgggggttggggggctggggtagggatagcattaggagaattagaagaaatacctaatgtaaatgatgagttgatgggtgcagcaaacaaacatggcacatgtatacctatgtaacaaacctgcatgttgtgcatatgtaccctagaacttaaagtataaaaaaagtagtatttctgtatgccaataatgaaaaatctaaaaaagaaataaaaaagtaatcccatttataatagccacacatgaaattaaatacctaggaattaactcaactagagaagtgaaagatttctatatgcatactataaaacactaatgaaagaaattgaagaggacaccccaaaatgaaaagtatttcatgtttatgaattgtaagaataaatatgttaaaatatccatactacccaaagcagattgcatcaaatctatatctatatatttcaattctgtcaaaacaccaatgaaattcctcacagaaatagaaaaaaaaatcctaaaatttatagagaatcacagaatatctagaatagcataagctatcctaagcaaaaagaacaaaactggagttatcacactacttgacttcaaattatgcacagtacccaaacaacatggtaccggcataaaaacagacacatagaccaaccagtggaatagaatccacacacctatagtgcactcatttttgacaaatgtgccaagaacatacactggggacaagacagtctcttcaataacagaaaactggatatccatttgcagaagaatgaaactggtgctgggaaaactggatatccatttgcagaagaatgaaactagatccctatctctcatcaggtacaacaaaatcaaatgaaaatagtttaaagacttaaatctaagatctctaactatgaaactactacatgaaaacataagggaaaatctcaaggacattggtctgggcaaatatttctcaaggaataccccacaagcacatgcaaccaaagcaaaaatggaaaataggatcacatcaaattgaaaagcttctgcacagcaaaggaaacaatcaacaatttgaagagacaacccacagaatgggagacaatatttgcaaactatccatctgacaagggcttaatagcccatatataaggagcttaaacaactttataggaaaaaatctaataatccagtcaaaaatgggaaaaagatttgaatggatatttctcaaaagaagacatacaaatggcaaacaggcatgttaaaggtgctcaatatcattgatcatcagagaaatgcagatcaaaattacagtgagatatcatctcaccccagttaaaatggcttatatccaaaacacaggcactaatgaatgctggtgaggatgtggagaaaagggaaccctttttccacaactcattgttggtgaaaatgtaaattagtacaactattatagagaacagtttggaggttcctcaaaaaactaaaaattgagctattataattcagcaatcccactgctgggtatataccaaagaaagttagtgtatcaatgagatagctgcactcctgtgtttgttgcagcactgtttacaatagctaagatatggaagcagcctaagtgtccatcaacagatgaatggataaagaaaatgtggtacatatacacaatggagtactattcagccataaaaaagaatgagatccagtcatttgcaacaacatggatggaactggagatcaatgtatttagtgaaataagggagacacaggacaaacatcttatgttctcacttatttataggatcaaaaaatcaaaacaattgaactcatggacatagagaatagaaggacagctaccagagcctgggaagggtagtagtggtggtggaggaggtggggatagttaattggtgcaaaaggtagttagaaagaatgagtaagacctactatgtaatagcataatagagtgactatagttaataatagcttaattgtacattttaaaataacttaaagggtgtaattgggttgtttgtaactcagaggataaatgcttgagaagatggatacccaattctccgtgatgtgcttattttactttgcatgcctgtattaaaacatctcatataccccataaatatatatacctactatatacccataaaaattaaaaataagaaaaagaaaaaaagaaaatgagttggctgtatacgtgtaaatttatttccgtgttctctgttctcttccattcgtctctgtgtctgtttttatgccaataccctgctgatgtgtttactatagctttgtagtatattgtgaagtcaagcagtgtgatatctccagctctgttccttttgcttatgattgttttggctatttggagtctttatggtttcatgtacatcttggcattattttttctacttttgtggttacttatttttgttgttattgttttgtttttgaaatggagtttcgctcttgtttccgaggctggagtgcaatggcatgattttggctcaccacaacctctgcctcccgggttcaagtgattctcctggctcagcctcccaagtagcttggattacaggcatgcgccaccacacccggctaattttgtgtttttagtagagacagggtttctccatgttggtcaggctggtctcaaactcccagcctcaggtgatctgcccacctcagcctcccaaagtgctgggattacagatgtgagccactgtgcccagcccatattggtgttttaatagagattgcattgaatctgtaatttgctttaggtagaattgtcattttaacaatattatttcttccaatctattagcatgtaatatttttcaatttttttgtgtcctcttcaatttcattcatcagtgttttatagttttccttgtataggccttatagttcttcagttaaattgattgctaggtattttatattttttgtgggtattgtaaatggtatggctttcttgatttctttttcagattgtttgcccttggtatttataaatgctgatttttgtctattgattttctatcctgcaactttactaaatttgtttaccaattctaacagttttttttggtgttgtctttacatttttctaagtataagattatgttatctgtaaacaaggctaatttgacttctttgtttccaatttaggtgccctttatttatttctcttccctaattgtctggccttatttaatttttattaattaaaagttaaatagcttcatatgtctagtggctaccatactggatagtacagatctagaccgatcaaacttcagatggttgggatcaatctgtaccatccctcctaagcttcgtcttcaaatgatcactaataactcttctgaattctgttttggatttcagtaagttattccaaaaccaaatgaagctctagtttaattagaccgaagtgtcagttgcacaggtgtgtgtgtgtgtatgtgtgtattcaaagttttcaatttgctcacatttgtatttcctgtaattggttctataagaagataagcatgtacctattcattgccaaacaacttaagataaacacatacaaaaacaaacctgagaaatacagagcaatacataattatgtatctgtctttaaaagctaagagacagaaggataaagattgagaatacttctttcactaactctagccactgttagagtggcttcctaaagaagacgacaagacacttacgttgcactctgtgcaaaattagccatttctcctctgaagagggcccagcttttatattaaaaaatagattggttattttaaatacagaatattataaaaaatattcagcaatcatcaggtggatattcagcaaattattaacttccaagtatagcatttcaaatgttttattggttaaatgattataataatatcatctttttaatttaacttcaagtttattatgagggtaaacatatctgtaaatatttctgatgttaaatgtgtaatgtaagcacagtatactgttttagggattacaacctaggaagaaaataatacaacaaactacaaagcaaaaatgtttggctaccggctaaattttcagaattctagaggaaaagaaatggaactcaaaataaaaaagttaccctgcacaagaaagtatacaacagtttgaatgatctaacagacaaacgccgcttcccctaaacaataaaaaagcaacctaggtgttaacgaagttctggcagcttgtctgtgcaggctactcaacaaggcagacaaccttcagaaggaagatactcgctgtcaggttcatccagctataattggagtatatattgactttggtcagtttggcaaagagaatatcaacttacaaagtgctagctacgatggagatgcgataactggagatcattgttaagatgtctgccactttcaaaaagatttgtctttagaagctaataggaattttaaattgctacagcaattgcatgtcaacatgagctatttattggctgttaaccataaatgtataatatattaatgtgtttgaatatactctttctgtcattaaattcaattaaaattgaataattataaacatataagtccctagagcctaaaatcaccaattttcaaggaaaaaaaagaagataagaaattattcatattcaatcacattttgccatcaaatttatttttcagatgaaatatttgcaacaaataaagacttaaaattgggtgccgtaatagaatgattaatagatccttacttccagataaaatgattaatgcttccattatgtatattatgtagcgttcgagttaaatatgtcaatatgttattgtattcagtgaatagttcaattgatctttcctctcttaaattaaagcaaatcattttataaaggaatatgtatttcagaagtacatagttccataaataatatgtttgaaagcatgaaatagataatgccttggtttgatagaccccaaaactgaaactgaaattacagtcatttgggataactaacctattgttttacatagttttgtttcaagcttaccagtgaacagaaagaaaaaaaaactaatcaaattattttcaatggggctacaaagcattgcattgtaacctgaaatccaaagcttacattggcttgaaaatttgaccaggcttacttagctgaaagagtccttttagactataaacttttgctaattttgtaccagaaaaactgggttcaaagattttattcttcattctcctttaaatcatatatatatatatatatatatatatatatatatatatatatatgattttaaaatattttttaaaagagtaattcagaaaaaggataaggaaactcaattgtcctgatcacgtaagcaaaactactttgagattagcgtttagaaccaccctttttccctcaatctggttcctagttcaggaaaggtcattttatataccagaataaatgaaaaaaattatttctgccctactgcattggactagtgtcctcactaggagttcatgaaacagtttcaataaaaatgcaattacaataaggtattttaaatcatattaatatgattaccttagactcacattgaaaatacagagaatgtttaatttttagaaaatgttaaacactttagtttagtaaatcctatcatgttttccagtaatgctaaaaggtgcacaatactttttcattttaggtgccctgtgactagagacttggcacttgatggctgcaggggaatcactaatgagctacaaagcctttacacctctaggtcaggagtttggcttagacctaggttgggagtgacagaaagtcgttaccatctcatgatagttcagtggtttatatgaaggaaattcagtgtttcaggccactttctaatgaacaagcatccaccttacaaaaagtcaccactgcttttgaaagtaattggcaacaacctagagaatgaaaaatttaaccaagatttgtgttccttccatgctatgactaccgtattcaagtaaggagtttttaatggaaaaagacacagtacattgcagatatgcctatgaaaagtaaggctagggaagaaaaggggggggagaataatgaagagaaaagagagagtcatccagaatagagtaaatcaaaatgcagttaagacatgtcatcaaaaacctttacttacagtttatatagcaaaggtatttaattcagaaaagacatgcacctattatgtttctctttagtaaaattttaataattttacctgaggcctttagattagggcatcaaaaagatgatacatgcctggaaatggtgtttccttagcagagagttgtcactacacatgtcgttattatcttctttaggaagccatagtggctagagttagtgaaagaaggcttctcaatcttctttcttccaagtcttttagtttctacagacacagacacataattatgtattgctctgttttattcagggttgtttttgcatgtgtttgccttaagttgtttggcaagaaataggcacaggtttattcttcttacagcactcattacaggaaatacaagtctgagcaaatgaaaaacttagaatatgcacatagacgcatgtgcgtgcacacacacacacacacacacacacacctgtaccattgatgttttcatttaatgaaatctgagctttgtttggttttgaaattatttaataaaatctaaaatgttactaatgatcttttgaagacagaagcataggaaggatgtggcagagtgtttccaaccatctgaggtttgatcagtcaggatctatgctatccagtatggtagccactagaaaaatgaggctatttaaattaaattagtgaacacttaataaaattggaaattaagttcctgagttgcactagccacatttcaattgttctgtagccacatgtggatagtatctaagttatctgaacatttttatcatctcagtaagttctattgaacagtagggcccagaccaccttttcatccctatgcttaatgtttttatattaaaatataatattttatgtaataataaaaatcaaaagaaataattggaaagtaatagtgaaacctaaggaaaaacaatgaaaaaatgcattggagttggaagcttatataatgcatggtctataataatatcccactaattattatattgaatgaatgcatttttcattttttcaatttaagatacttgaagattttgattttcaagagatacgagaacttgatgccttcttttttctttgcaaagaagatgatattaataatttgttataggctggccctggtggctcactcctgtaatcccagccctttaaaaggctgaggtgggaggatcgcttgaggccaggtgttcaagaccaccctgggcaacatggtgagcccctctctctaaaaaaaagtaaaaaattggctgggcgtgttgttgtgcacctgtagtcccagctactcagaaggctgaagtggtgggaggattgcttgagcccaggaggtggaggttgcagtcagtggtaactgtgacactgtaccccagcataggtgacagaatgagactgtgtctcaaaataataataaaaataaataataataataatttggtgttatttttataccttgaatttacttaataggaagaaatatatcaattagagggtactggaatcccttggacttattttttctttttcaatgaatgatatgtttgcctgcacaagcccaaaaccataaaccgatctagaagatgaggacacacaaatacttctctaatatcccagaggtgaagttcacctgcatgtcagatattagcactgagaggggatattcctatttgggaacatttctgtctaaaatattaccctctacattattttataaatgatgaactaactaaagaaaaagtttgagaatgttggtggatgggaaaggagcaactgttgacaagtttaatttcattttaagccattatcacaggggatatgtgtatactatcttagaatctgccaatttttcagcttattcataacagtcaaaggaaagatgttatctctatgcttatagtgaaaagctttggaagtcagaaagcaaatcttttattaaattcttgtccagggttcatctgtcaggtctagaaatgactagttattgttaccgtgtacaccaagatcatctatgagtgatatggaaaaatgaaacattttaaaagaattcgagaagcagtgggtccctgttcttgcctatcaattttgtaatgaaacaacaattccttgtatttacctggacagttcttccaatgcaagtcagatctatttaaagtagcaggtttgtaggaaaaggggtatcagagaagcaggtaagattacacgaagagttaaagaataatgttgctgtaatgttaacaatcatatttataggaatacaaccagggaaattcttcaacatattggtcaaagataaattaataaaatttcctgttcaaatatacagttagattgctcaagtatactgagcattggaactttttataaaatggatccttcggagtcttaaattagtctaataatggcttaaaaaagtgattgaaatgcagcagctttggtgtcctgttgtaactttagtgaaaatactaattctggatgtttataaacaatttctacttctactttctctagagaatttcaccccctgacacccacatcacaggagataacacaagaatttatttacaataaattcaagtttccctgaaaaatatggtacggtaacctgagagaagattaacagattattttctcatcctaagtgtctgctattttagatattgaccatatgagagaatgagttttaaaaaaacttttaatttttaatttttgtaggtacatagtaggtgtatatatttatgggatacatgaaatgttgtgatacaggcatgcaatgtgaaataaacacatcatggagaatgggatattaattccctcaagcgtttatcctttgtgttacaaacaatccaataacagtcctgtagttatttttaaatgtacaattattattaactatagtcaccgtgttgtgctatcaaataataggtgttatttattatattttattttcgtacctagagtattttcttacatgaataaaagataatgatattccataccatcttgggaatggaatcccttgatcccaggtgcctgtggaaatgttcacacttttcacgggtgaggataagtgaggaaagaataagagcagaagggccctagagggaaaccttaaagaacccgagagtagagaatggatggaagtaggtgatgttgctttttcttccttcctcactgctctcccttctgcaaaggtgaatgtcttcttgcctcagctttatttttcaaattgtaatcaagaccaaaacaagtcagaccattgagactcatttgttttctttccgagtgaaagcaaacagatctaatttcattctgagacaaggcaggtgggcttaatagacagtatgggggtgggcaaagaggagaaatggtaactgtgggaagacatcagttgtaatttatcttgacttagtaagacttttcctttttgcatgacatactgctcaacaaatggagagacactccagttaagtaattgctcagattattagtgtgttgtgctgaaaaaggactcctaagctgcattagcttgggttgacatcgcagatgctcatcttcaaggggtcagtacaagaatgaatctatttaacatcttcatcaatgatcaagataatggaaaagatacagcaggtccattaattaacattaggaaagacattatactgcaagggtagcttgcacattgtagggcagtgtatgaattttaaatggcctttaccatgataaaacacttgtcctttgcattcaaaattttaaaggctatttttgttcatccctgcaggcatggctaagaaaacaaataagtgaactcttgctactgtgaatctctgtgttctatttgctaaagcacagggcactaggactggaacagctttactttaaatagaacgatccattttttatagctgcagccccaaatgatttcctcatttccctatatgtaactctttcccagaatttcaaggcaatggtgtaaggcagggtcagatacgtaacttgaagagcccactgtgaaaaaaagaaaagcactctttgttcctaaagtagaaacaaccactaaagctactaagatataaagcttttttcatttcttcattgtttctctattaacttgttatggtgtttttatttactatttaatatcattctaagaaaaaaattgacaatttaaattattagcataaattaataatcacctttatattgtgtattgtcagttttaaatgcacacaggggaacattttactcatatatgaaatcaccaaaattacgcaattcatatttggtagctcatagtaaactggtaccagttgagtcggggtgctgctaaaaagatactcgaaaatgtggaagcgactttggaactgggtaacagacagaggttggaaaagtttggagggctcagaagaggacaagaaaatgttggaaactttggaactccctagagacttgttgaatggctttgcccaaaatgctaataacgacatggacaataaagtccaggctgaggtggtctcagatggaaataagaaactcgttgggaactggagcaaaggtgacttcgttgattttgtgtagaaagtttgatgcctgcttttttcacagtaaaatgctgacataaaaaacagccatcctaaaagtttccatcttaggtgggcagccatttacctttttctgccatcaaattttatgcatcagttgtacaaatttaaatatcaggcagaaaaatatacattggtgtggctcacatttacaacttcttagttaaatttttacctttacattgctcttacttagctcaattttaaaaatatagtatttttgtttactagaggaaattgaaaatatagaaacaataaaatgaagaaagaattatacacattgaagatagtcaatgtaaatagttttccacttcttttctggtcttttctaaatgtacaactttaaaaaatactggcagattccaaccatatataaaattttacatcttgctttttatgtaatattatattgcaaacattttttttcatgttacattctgcctggacatttttatggctgcagagtgtattaccacatggatttatttaatgcttactccatttttggacacaatttcatttataataaatactgtgatgaacatctttttgaataaaacttttctcatttttcaaggttatgtccttaggatacattccccgaagaacattactgggtaaaagcatctcagacattttaagtctcttgattcttgttgacaaattgctttcaaaggagacataccagtttttactcctgctagggatttaccacaatgcttgtacttcgttaaatgtagattactgtgattaatggtgatgggcatttttatatgtgtttgttttctaattctaattcctccatcgtgaagtatggtatctccttcacgtccttttgtagaccactcactcttacaggcatgatctcctggcaaaagtatggcagaagaaaacactgaaacatttctacagaggttgtatcatttctaatgtctccacttccctagccaccctgccttttaaaaattgggagaaaatcagaaaaaagctgatatctctttttttcaaagtttatttttcttgcaaaataatatgcttatattgcataaactaaacattgcaaataaagctaaagcatcccttgaccaagaccacaatgttgcacaaattcacagactatttgtgaccagcctgggcaacatggcaaaaccccatctctacaaaaagtagccaggcttggtggcacacgtctgtagtcccagctacttaggaggctgaggtgggaggatcacccgaacctgagaggtcaagggtgcagtgagccccgatcataccattgcactcccgcttaggtgacagagtgaaatcctgtctccaaaaaaataaataaataaataaaagaaaaaaaaatctacagaccaccttacacagttagttgtgcagtgttgatggagagaccctgggctggacaatatctgcttgtcattcccaatctttatcctctcatgggagggaaacattgctctcggttttatgtaaatccccccagatgcttttctttataaaattttttaaaaatttcattttcttattattaccatagtggaatgagcagaactggcttatccctgcccctctccttagcttgtttcctcatagaacgctgatgccttttccctgcattaaattccagttagtcctattgtttagtcctctttctgtagtccgggccagttgttttccacatttacatgttgtgaatatggttttgcatctctctagcagtctgatcccagagcccctctccgattttttatttttaaaggttcaggatgttttgccttattaaggaatgctgcggagaaacatgttagagaaacattattttaggatgccaaaatctttttctctccctaaagctaaaacacatacagtttcactctaaggaaccaattctttagaaaactgagctaaaacggaaatgaaatgaaaggcggcctacattaaatttcatttagtcctattgtttaatttatgttctgggctactcgattccttttaggccctaggcatgcaagatactgtttccgtgtgcttggtcactccttcatattttatcctatctttgggccttatggatatttctgttctggaggcttctgaaatcagtcggctctctttttgggagagttggtaggtggagtgggatatgttttagcaggcatgttggtttatatattttttccattaaacctattggctttcttctttgtgagtttaataatgtgatgtcttgcttctgttgaccaatttttaaagttttgattattcatttgtactcggattgttttgccatattttctgagtaattttgtttgtttgtttatttatttatttatttttagtacagccttgaaagagacattagatttcctaggaaagcatgatgaaaacacactctaacccatttgtggacctttgcagattaggggtgcttccatattgtgagccatgtggctaagcaggatatgattgcctcgtttctgacccagcagtcaaagatgctgtgctttgctggagggaagtgttcacagctactgcctgtgttgtaatttttttttttttttgagaattaacagaagacctgaatttttagagttttccatatggttgctttcctagtaggactaacattgacttaaaaaaaaatccacctcttcactttaaggaaaagaaaagtcctgagtcacttagtattccttacactcaggaaggctgactataaaggcttacacttcctgctgtgattgtatccttcttgaaagaaatgaagcagcaacatgaacttagttccctttatctgcacagtgattctaagtctcagtttctgccgtcttccctctctgactatttaatacacttatcgtttctctgcctggcattcccctataggagagattgaatttaacaaatgtacactaagaatgatagctgacactaattcaatgagcagaaggttaaatccgatcataattcctgaggtaatggagacgggtcaggtatgcagatctctgaagagtcaaagagattaaaggagactacacagttcctttgactctgtagccactaggaaactataatagcgttttaaggtagggtagtactggagcctaaagatttattttttaaaaaatgaacaaagcatcacagtcaagctgatgcaataattttgcaatcctttgagctgttaaactcaagaaagatgttagctaaatgcaatctggaataaatacattaattttcacatttccttttccccgttgcgcatagtcttgaactattttaactcagatgaactttagtccatgttaaaatctggaaagagtatctgcaaagatataataaatataaataaattacattaaggatatacgagtggaaaagggagaaagaaaaaatttgcaaacacttaaaaaaaaactgcttgatttaatgtctgtagatggaagctgtggatcagtacttcccatgagactccatagtggattgtcgctgatggcaactaacagaaaactaacgaaaaacttgcacctggggcccttgctggattcgcctctaacagcccttctcagtgggatggcaggatcagggttaaggctgataagataatggaatctgtgcgtgcccggcctgattgctcccctgatctgatcactagtatcggggtgacagctgcttttccaaccctctgggcagcaagtggcagagcagcatgtcaattgcatgtgcatatttagcagtcatatattgacaattaaagagaaagtgtttcacatttgtattacccttattaaagagtatgtgaaatatttagtcaaagagttggagggtttagagatcccatgtgaatttttgcatgactgagcagggttcttttaaaatatacacttgatcagtgaattatgataattcttgcattggtgtgcctgtgtaaagatattgaacattacatatgcaagtcacatatatacctcagaggaagactgtcaagttttagaattgcaatagtagtacatgacactgaaattgggatgggtttgttataattcaaaatggaggtaatgaaatcagaaaagaaaaaaaaagaactggaaagagaatgttttgttttcagggattaaagctttctaaattagtgggttagaataaagtattgtgtcactaaagatagtaaaatgtgtaaatacattactttttatagaaaggaaactagtttatatatacacacacagacgcatacacaagtatatctgttagtatatatccacttaaaatgtgcatactcttatatctcagatttccacatccaggaataggtattcttcacctgcccttttcacttaaataatgtctcttctttgttgtttggttttgcaattgaagggcacttccttttcttctgtgtaaaaattgtgtatttgaaaaatacaaaagaatacatgtaattgacacgtaagcaatgaagcatgataattactgaacactagtgaatctaccatgcaattaggatctggaacattatttatgtaattgtgttacacttctatttcatcctattttctacttcctatagatactcagtaaactgaattttatcatttgttttcccaaaatggttttatcatataagtacatattcttttcataatctcatttttcaaaattaaggtatcatttacatacagtaaattttattcattgtgatttacaattctttggctttttacaaacacctacccatcaaaattaagatatagagcagttctattacctctcaaaatcatcccatgccactttgtaaatcagtccctcccctttttccccactcttggcaacctctaatctgttttctgccccaagagtttagccttttccagagtgtcatttagatagaatcatatattatatacccttttgagccttctttccttctgcataacgcatttgagattcattcatgtttttgtacatatcagtagttcatttccttttatgagtagtagtattctattataggaatgtattgcagcttgtttattgattggctagctgaagagcaattggtttccagttttttgcaattgtaaatgtatcggctatcaatatttgtatacacatttttgtataaatataaattttcatttcatctgggtacctacttagaagtgaaatttctgggtcatatgataaatgtatgttaaacttcataaaaaactataagatgtagcacgcatttccaaaggggctgtatcattttgcattctcacaagcaatttgtcaaagtttcagttgctctgcacccttattagcatttaatattgtcagttgcctatttttttccaaatctagccattttaaattaatggtatctcactgagttataatttaaactttctcaatgactaattattttgagcaactttgtatgcttgtttatgatctatatggcttgtttagtgaagtgttcactttttttgccaattttaaaacatatgttgtctattttcttattgagtttcgagaatttttatgcacagatacaaatttgttttaattagatgtgtgattaacaaatattttcttccagtctgtgctttgtcttttcattcctttaacagtttttgaggatcagaaattcttaattttgttaacacataatttatgaatttgttttatgcattatgcttttggtacctaagaatttttcacctaacccgaagtcacagagagtatctctgatttctcctagcagtttatagttgtatgttttacatttagagtagttactcactttcagttacttttagtatattatgtgaggtagggatcaacatttatacattttttgcatatggatagctaattgcttcagcatcatttgttagaaagattattctcaattgaacagactttttatctgttaaatcaagtaaacatgtgtgatctacttctggattgtctacttaaaaaacttgatttaggtgtctattattttaccaatgccatattgtcttgatgactgtagctttaatgtaaatcttgaatcaggtattgtaaaatcaggtactttaaaacaaagattattttggactacttaattcttttaactgtccatataaatttttgaatcagcttgtccatttctatgtaaaacttgctgagattttgatgaaattatattaaatctatagatcagaatgtggagaaatgatatcttaaccacaccaactcttccagttcataaaagtcacttttttgatgtttaaactcaatgttatgtagttttcagcacacagatcttgtacatattttgttagatttataactaagtatttaatgttttggtactgttataatagtactttaaaaattttgattttcaattgttcatccttattgtatagaaatattagagagttttaaatatagaacttctatctgaaaacttaaatcacttattagtacttttagctttctaaaaatagatttcaggattttatacaatcttattgcccaagaatagagacagttctatttcttccttttcaatctgtatttcttttatttcttgtgattgccttactgcactgtcttggacatctggtatgataaacaggaaagcagacatctttaccttgttctcattgtatggggaaagcatttaatctttcatcaataaatatgatgtaagctgtaggcttttttggtatgtgttctttatcaggttttggaagtttctttataatttgccgaacattttctataaattacaaatcagtgttcaaatctcttaaatttttctcttatctttcgagatggtgatttttttttcttctctattacatttatatagtggatacattgattgcttttcaaatgttgaacaaactcagcattttaaaaataaaccccacggtggctgagtgcggtggttgacgcctgtagtcccagcactttgggaggccgaggcgggtggatcgcgaggtcacgagatcgagaccatcctggctaacaatgtgaaaccccgtctctactgaaaatacaaaaaaaaaaaaaaaaaaaaaaaaaaaaattagccgggcatggtggcggtcgcctgtagtcccagctactcgggaggctgaggcaggagaatggcatgaaccgtggaggtggagcttgcagtgagctgagatcacgccactgcactccagcctgggcgacagagcaagactccgtcaaaaaaaaaaaaaaaaaaaaccccttggtcatgatgtattattattgttttttttacatattgttgtattcaaatttactggtattttggacaagcgtggtggctcacgcctgtgatcccagcactctgagaggccaaggcgggcggattgcctgagctcaggagtttgagaccaccttaggcaacatggtgaaaccctgtctccactaaaatacacaaaattagccaggcatggtggcgtgcgcctctaatccaagctactagagaggctgaggcaggagaattgcttgagctgggatgccgaggttgcagtgagccgagatcacaccactgcactttagctcgggcaatagagtgaaactccctctcaaaaacaaaaaacaaaagacaaaaaaaaaaaaaaaaaaaatctcacgaaatttaccggtattttgttgaggacttttgtctctttattcatgagggacgttgctgtgtaattttttctctccacccgccccgcacctccgtcttgtgttgtttttttctgattttggtattagagtatttttggatttaccaaatgagttgggaactggcccctattttctattctggaaaagattgtgtcaaatttgtattatttctttttcaaatatttgggagagtttgccagtgtggccctctggcttaaagagtttttggttggaaactttaatctagaagtacactttaattaatagatatagaattatttggattatctgttacatgattgagatttcctagtctgggtcttttgaatcatttgcccattttacctaagttgttcatttctgggcatacagttgtttgtaatattattattatcctttaaatgtctgtagtatttatagtgatgtctccctgtaaaaattcttaatatttgtacttcatatcttctctcttactttgttggtcaatttggctggacgagtacaatgttttttgtttttttttttttcaaaaaatcgctgtggttttattacttttctctatttttttgttctcagtttaatttctatatgttttattcattctgtttgggtataatataattttatttttccagtttttaaggtggattcttagaaagttgcttttcaagtatcgctctagctgcatctcacgtattttgacaggttatggtttcattttcattcaattaaaatattttctaatttcctctatgactttcactttcatctttgggttatttagaaatgttttgtttgctaaccaattattttgggattttccaagtatatttctcttactaatttgtagtttaattccattatggctacagaacatactttgtatgatttaaatttctacaaattttaaatgtttttaaatttttatttttttttattatactttaagtactagggtacatgtgcacaacatacagatttgttacatagctatacatgtgccatgttggtttgctgcacccattaactcatcatttacattaggcatttctcctaatgctatccctcccccatcccccaatcccccgatagggctcagtgtgtgatgttcccctccctgtgtccaagcgttcaattctcatctatgagtgagaacatggggtatttggttttctgtccttctgatagtttgctgagaatgatggtttccagcttcatccatgtccctgcaaaggacatgaactcatccttttttctggctgcatagtattctatggtgtatatgtgccacattttctttgtccattctatcactgatgaacatttgggttggttccaagtctttgctattgtgaatagtgccgcaataaacatacatgtgcatgtgtctttatagtagcagggtttataatcctttgggtatatacaccagtaatgggatcactgggtaaaatggtatttctagttctagatccttgaggaatcgccacactgtcttccacaatggtcgaactaatttccactcccatcaacagtgtaaaagcattcctatttctccacatcctctccagcatctgttgtttcctgactttttaatgatcgccattctaactggtgtgagatggtatctcattgtggttttgatttgcatttctctgatgaacagtgattatgagcattttttcatgggcctattggctgcataactgtcttcttttgaaaagtttctgttcatatcctttgcccactttttgatggggttgtttttttcttgcaaatttgcttaagttctttgtagattctggaaattagccctttgtcaggtgggtagattgcaaaaattttctcccactctataggttgccttttcactctgatggtagtttcttttgccgtggagaagctgtttagtttaattagatcctatttgtcaattttgcctttttttgccattgcttttggtgttttagtcatgaagtctttgcccatgcttatgtcccaaagggtaatgcctaggttttcttctagggtttttatggttttaggtctaacatttaagtcttttatccatcctgaattaatttttgtgtaagatggaaagaagggatccagtttcagctttctacatatggctagccagttttcccagcaccacttattaaatagggaatcctttccccatttcttgtttttgtcaggtttgtcaaagatcagatggttgtagatgtgtggtgttatttttgaggcttacgttctgttccattggtctatatctctgttttggtaccagtaccatgcccttttggttactgtagctttgtagtatacattgaagtcagttagcacaatgcctccagctttgttcttttgacttaggattgtcttggcgatgcaggctcttttttggttccatatgaactttaaagtagttttttccaattctatgcagagagtcattggtagcttgatagggatgtcattgaatctataaattaccttgggcagtatggccattttcacaatattgattcttcctatccatgagcatggaatgttcttccatttgtttgtatccgcttttatttcattgaggagtggtttgtagttctctttgaagaggtccttcacatcccttgcaagttggattcctagatattttattctctttgtagcaattgtgaatgggagtttactcatgatttggctctctctttgtctgttattgttgtataggattgtttgtgatttttgcacattgattttgtatcctgagacttttcttaagttgcttatcagcttaaggaagttttgggctaagacgatggggttttctaaatatacaataatgtcatctgcaaacagggaaaatttgacttcctctttgttttatgatccagaatgtgatctattttagtgtatgttccacatacatttgaaaagaatgtatagtcagtcattgttttataaatgtcaattaggttaagaggattgattgtgttgttgaagtcttttatattcttactgaatttatgtccagttattttattgattagtgagagaaggatatttaagtctctaacaataagtggtttgtctattttcccttcaattttattagttttcttctttgtatattttgatgtacaattagatgaatgcatgtttggaattattgtcattctactaagctgcttctctttattatattaattttcctgaagtctactttgtctactatttagatagccactacagcatttttttttgtggttgtttgcatgatatatacactctcgtccttttatttttaatttgtctgcatatttatgtctaatgtaagtttcttgaatacataatgcaattggatgttgcctttctaattaatctaacaatcttagttttaaatgaatgtgtattttggcattttatgtaagtactgacatttttggattattctaccatcttgccagttattttttgtatgcactcatctgttttctgattcttttgttgttttcttttgtattgagtatttattttatgatgattccgttttatctataccattcacttattatttttagttagtatatatttttatagttgttattgggttcatattttaattaatcatatattttatgttcacatcacatatagtgcttcatagagccttataatgttatactcccaattcctccctcccttcttttgggatctttttataattttatattcacatgtgctataaatacacaataaattggtactattttttgatgtgataatccactatcttttagagtaacattatatatttgttcataaatattatttccaggactattcatttctttgtatagatctaaatttctgtgtgatgtcatattctttctaactggggaatttcctttaacatatcttgtagtgcaagtgtgctagtaatgaattctctcaagttttgtttgtccaaaaaagtctatattttaccttcattttgaaaggtgttttcattgggtatagaattccatatttaaatttttttctgcagtaatttaatgatattcttccattgctttcaggcatgtataatttctgacaaaagtctgctgtaacttttaaatctttgttcctttgtatgtaacttgtttttcccctggcttccttcaaaatttttgatctcctttggttttaaaattttaatataatataatataataaatataatataatattataatataagtgtgggttttttggcatttattctccatggcaatacttgagtttcttagatctggaatttgctgctcttccttaatgttagaatttccatttactttttatcttttctcttggtattccagttacagacatgttaggccattttttgttggtccacagctcttcaatgttttgttcaccctctcaccttctttctttcttcttatttttttggattccagttctattgacttttagtcaagatcaccaattctttgtctttagcgtgttcaagtctattgatgagcctatcaaagaattcttcatctctactactatttttcatttctaccattacaatttgaacttttattctattattttttacctctttgctaaaaatttttatctgtttatgcaagttgtcaacttttgctagcaggacttttaaaatataaataatagttatatcaaattccttttctgataattgcaacatctattatatttgagtctggtactcttaattgcttttcctcttcacattgttttttcctttttcttttctttttttgacagagttttgctcttgttgcccaggctggagtgcaatggtgcgatcttggctcagtgcaacctctgcctcctgggttcaagcaattctcctgcctcagcctctctagtagctgggattacaggcatgcgctaccatgcctggttaattttgtatttttagtagagatggggttcctccacattggtcaggctggtcttgaactcctgacctcaggagatccacctgcctcggcctcccaaagtgctgagattacaggcgtgagccatcgcgcctggcctttcctttttctttataccttcttctttgtgtattttgtaattttagccgcaaattggacacattgtgtaggactgaggttcatagtagtaatgcttgtaaataggcatgcctcattcttttctaggttgtaaagcaatccatttgagaggtgaaccaattctgtgttttcttcttgctgtaatttatataatgctccaaagttttcaaactcctccagcattactttgtgcttaggatgggagttgagataatggagggtttttctgaatatacttactctatacttagcttttgacattctctgttaaacttgtaccttagagaatttctctctctgttttctccttttttctagtagtagattactgttattatttacttggtacttgctttcctggttggcgggggaggtgacagagtgctttctgaggttctgttttagtttgagtcctaggcatgtgttgtgtgcccgggtcttgattgtggagtcttagtaagcctgcttctgagcagcttagctgagcagggaagtctcagttttctagggctgctgaaacaaattaccattcactggcttaaacaacagaaatttattctctcaaaatcctgaagactataaattagaaataaagctgttagcagtgttgattccttttggagacgctgaagaaagatatgttctatgcctctctcttggctactggtggttcccagaatccttggtcttcctcgggttgtagataaatcactccaatctctgcctccatcttcatatagtgttcttttctttgtgtttctgtgtcttcacatggtcttgtttcaaggacatctgtgatgatatttaatgcctaccctaatccactatgatctcatcttaacttgattacatctgccaagaacctatttctaattaagatcacattcacgggtaccaggaattaggacttcagcatgtcttttcttgagaatgtgttagtttgctagggctgttataacaaaaataccacaggttggatggtgtaaacaacagaatttattttctcacaattctggaggctagaaacccatgatcaagttttcagcagctttggtttatccttaaacctattttcttggcttgcagatggtcatcttattattgtgccctctcacggtcttttctttatatgtccatattcctggtgtctctatgtgtgtccaaatttcctctctttataaggacaccaatgaccccattttaacttaattacttctgtaaaagctctatcttttaatacacattttgaggtagtggggtttagagcttcaacatatgaattgggatggaggggaaagagacacacaaataagcttataacagaggacacaaccccaagctaattgagcgtagtagggcctaggtttttttttttgcccttcgcccaaatgtagagggtctgaaaatgaataggacttttacaaaaaagttcttttatctattttcttactaaaaagttctactattttcttattcaaatctgcctgatcattatttataatacctttaaaatgtgtttgtgatctttgtgaaatcatatttaattgcttttaacttgtggataatctagaggttgaattgacaaatgctatgcttcataaatgatttgcatatatttcttttagaagccaagtgctactaccaaagtagttttaccttagccctttcctttccaggatcaccagattaatctaacagtctctagtttgtacctataacccactggttaaggtatttatctcctgattgtggttttaataatggcatgtatctatcaggtatgcctgcctattatgtgtctttaccaatcaccaatcagatttcagctcacagggttatttcttccttttggagatttctcttacttcttgggagcccattaatgtaattagtttgatgcaggatctagttctttggtaatatgtgaaccttccagaatatttagtccatcaaatctcaaaaagcagaagtgtctgataataaatttttgtaatgtctttccattccacttacatagatatacctccacctttccaatgtttgcatagtattagattttaagggtgtaacattttgagaatgatacctctatttgtaggcataaagactattcacagttatgagctatttcatgtgatatgcagtcagcataattgtgctgaattttcataaacttgtatcaacatatacttgtagaatacacttctgaaagtggaattgctgggttaaaggcattttgagagtttttgatacatattttcagacaaatttaaatgttgctagaaaatataaaaatgtttctagacttttgtatttaataatacttacctgttttacaaattatgatatattatttcctaatgatcaacatttaccctttgatggcagtaaaatcttgttcatatggagcattgtctaagaaggcaaattgtgcagaagatactatacttattacctaggtcctagtttcagatttgccctgtgtttgctttttgactttcataagttagcttgccttcttcattctttgtagctttatacatgaactacagatgttgaactagaacaagggttattaaattttattccaaggatgggaaaatgaacccaatgggtggtgctttgaaattcctgtccctacttcaagcaagacagctgcacttttatcttttttgtatcagaagtactgaagattattccatttggggaaaataaggttctgctgttaaaagtagtttaaaatctctttccctaggtagatctaaagtcactcctagttctaaagttttcttatgattttgtacatacttccaaattgctagatttttcagtattcgaactccaattatggctcctacgtttttccccttctacagtcaatgcaaaaataaactcacttatttagatgaaaagtaacaaagagcgagctgtttcttcctttaatcccttatcttaggcttctcttttgaattacaaatgctttagtctcaactacatttttaaagagagaggttaaaaatatgtgacttctcattatttattatccttcagagttagattgaatttaaatatagaatatcatttcttatatcctgtctttttttattttctttagtgtgtatccattgcctatgtattgatcatttcttaagtactgtttctatccctattctcatcaatttgtaagtcccagcatactttcccatagtcactattgaatgctatagtcacatttattttgtctgaacactactttcaccataataagattttttacatttctttgggaaactctaattaccttaggcacaagaacaaaattcttggtttaaatctcttaatcaggcttcctcagaatagtcactgaggcaaactgactcactctcccatgtgcctgattatctctctcagaatgtttgaaatgcactcaatttgcaactatgttaaaaacttctacatctctacaagttccactttttccattgttaaagtgtaaccttcttcaggaaattttttcctactaactggggataaaatgtcctcttttcttttatcattgcagacaaagtacttgcactttgtctataatgagaaaacaatagaactttttgaaatggattctagtgaggctgagtttgtattaattttgtctacactgagcagaagtttgactatgctatctttaaaaagaggtttaacagagaaagaagcataattaagacggtagaacatatacacacacacatcccaaaatttaaaaagttaagattatgaactctggtttctaatttaaatgagaacatctattaaaataatcaaatatataaaagactgtttcagcatattttgtgcaatttaaaaggaccttcctttgatttgaaaagtgctttattatactgtatttattcagtagtgaaaactttagataacttactgtagacgattcccagtttttcctttaggaccaaggcactcattcccacaccgttagaaatggtggctgaagagcgtcagctgagtccctcactgaggatagccctcaactaaagagtgtcatatcaaccaaagtcatatcctatctttgagaacagtctgcacccagtgcctactttggtggaattataaagaccttattttcttgccttgattgagacagctctgatatgttatcccagttccacagctcaccaaaggattggctcgggcctttgtcgtgacgtcgctgcagctcaactttttcctttgcttacctacttcctttacaaccccataggtattgttcgtgagggcactcctaaataaaattgctgcagtcctgacatttactgtgtaacaacgaaaaaaatgcaaaaatggctaatatttaaacagctattactatttcccaagcattgtgctgagaacttcagattcattaagtcatctaaacctcacaccaatatgagatggaaatgattattaaaatctctattttacaaatgagtaaactcaccttagagaaattatataatttatccaaattctacagctactagattgtaaagccaagatctgaaactatgtctgctacattccagagatgatgcttttaatgactaaattacactacctcctgcatcttgaggacctgtattgaatgcctgaaagggcattttgggatagagtacaatttaatgtttttgtcagtgaagaccagtgggtatattttgaaaattaaattttgctctatatttatattgtgagaagacataattttttgggggggttaaaaattattattatttttaagttataaacagagtactgtatttagatgtcggatattattgtatttttatctctgatgcaaatgaaggaatgtgaaaattaatttcatgtgaggaaattcaagcctacttactgacattaataaatgttgattttttgttagaaccaatcactgatgtgctagtgaaattccaattaattgtttgtcactattgtagacattaattggcattccatctataatttgtgacataataaaaggcaagatcaaaatacagattgtttttttaaatgtatttccaagctaattgtactagctacatgacatgactgatcttgtctactgagaagagattgactgttaatttagttaaaaaattcatctgaaaattcctttgttttccaggcacatacagatgtagtcttatgttagaaagcttttacaaagcagaaaaactgtatattaaattgctacttttatgtatgtgaaacaactttgatatttatatatattttgtaataaaatattttatatttgtatagcactggtgagttttcacaaatattatctcatataatttttatcataattgtgagataactgaggtggtgttattaatttcattttctagacaagtaaatagagtatcaggctaagtgatttgttcagatgactgaggtaagagtctgtctgatcaattgacatggtgaggctgtgtccccacccaaatctcatcttgaattgtagtttccttaatccccacatgttgtgagagggacctggttgggggtaatttaatcctgggggcagtttccctcctttgatagtgagtgaattctcatgagatctgatgtttttataaggtgctttcccccttttgcttggcagttctcctggctgccaccatgtgaagaaagaagtgtttgcttccccatctgccatgattgttaagtttccagatgcctccccaaccctgcggaactgcgagtcaattaaacgtcttttctgtataatttacccagtatcgggtatttcttcattgcagtgtgagaatgaactaatacaccaatgctgttttaactacactgacatgaacatattaatgttttctcctccttgagcaatttcttctctattgccacccttctgagataaaatgttttgttctccccttcagaggcaaatttctccagaaaaaaacctaatttgctccactcattttcaaattatgtaaccaccacttgtgaatgttttgcaatctggtctgttttcatcactacaaaagggcggtgctatcacagttcaccagaaatccttgtcactacagcatccactggcattatcacagatcaaaggtttcagatatcattgttcaccatctctcctaaacatattacatattttaagaaaagttcatctctttgtttccatattaccgaaagttgttctttcctctcctttgttaccttcattgaatacttttcctatctttcaagtagagttgtatatgtatactaaagatacatccttgactttcacctcttctattggcatattgtatcttccatttagtgtttatgatttcaattatcacctccatctaggtgagaagcaatatggtacaggggttaaaaccatggcctctggattcatattaaattgagtttgaatcctagctccaacatttctgtggttttgaaaaactacttcatttatacatgtaccaaattgatttacccctgcttacctcagagggtttgaagagttaaatgggataaggtatgtaaaaggcttagccattgagattcccaattgttttattttagtaaaatttaatctccttatcataatgctataatactctataccatctggctgcttcctacctccaggcaagcaatattggtggtaaagattatttggtggcagaacagatggaaggaagcagatgtatttaagacatgttttataggaaggatttacagaatgggcattaacttggtgattcggatgaagtgatgaaaaaaggttatactaaaataactttacattttcagcctcatagagttgggtagatggtgatgttatttactgagataggaatgactgaaggaggactatgattctggagtagattatgagttaggtttagagtatgcggagttttgagttccttttaggtatctaggtagaatgattgaatagacaattaaacaggtagcagcattcagaaaagaaataggaggaaaagaactcagaaatattttaagaaccacattaaaatccacacagaaagaataatacaactgaaaatatatacaatcaagaatgtgataggtaagcatatgtaaaacttaagtataaatattaaaattataataagtatgaaagacgtactagaaagtttatatgtatgcataactggttctgaagaaaaaaggatatataaaatattaataatgatatactagaagaaaacttttctgaaataaaagcttgtattattgttttattcaaaaatattcattatgtggctagtatttttcaggtgctattttaggcgttgggaacagaacattgaaaaagaaaagattgactgttctcatggaatttatattttataggactaatacttataccatgtcccaggaaaaatttaaatgaagcatcaagaagacacaccctcatgaagttattaaacatcaagataaagaattttatggatgtttagtcaatgaatgcaatttatttgtgtgggtggagaataatgttggcctctgtcttctctataataattatcagtgagaacacagaggatcaatagcatcaaaactttgagaaaatcaaatgtgtcccaataattttgacacccaaccaacatttccttcaaataccaaggcaatgaatagatattctcaagtaaataacaagtgaagaagtactgtacccatgcaccttagttgaaaatgacctcaaaactggacaatgacatccagccaaaaaagacacaaagcaaattaaaaaacacaggatagaggacccatactcttcactgaatatacttaagtatagaaatattaaactactgtgggaattttgtttgcagaacagaatatacatgctataaaccttataatgaacaattaaatactacaaggtggggagagaagagaaaggtttattattcctatttaattttcttatcttttatagtagaggttcaaaatgatgctctaaatttaaatcatgaggtttttttttcccctctgaagtgacaattcctatcttttaatgtttaaaattattttcttaactttaaagaattcttttaggtaccattattatgaataggtgtccaaactaccgtttcttcatttcgttttattttcttatgttgaaattcaaatgaatttaagtaatttagaaattgaaaataagtatgatctcatttgaactgctgttctttatgtgttactctctgctcgtctctgtgtataagtgggagtggctcctggagtgacagtctcctgatgatagtaacaagggttgcctttgggggttgggcagtattgctaatgtggtcagtttcttactgttaatcataaatggtagtatatggagaaaactaccaggaactgaagaaaagaaacagttgaaagtcatccctggaaatggagctagaagtgggtgtaagttgggagtggagaattaaccatcagaaagtttttaatcttcttggctctcttagttcacagattggaagtcagcacattttaaactatggagggcaagttatttaaacaatagtattttacagaaaactttctagttctgatgcatttgttgactgtttcagatctgacttgctaaatgcttccatttcaaacctcaaaacaatttttaagatattttgtaagtatatttgaaataatcacatattttttcaggggattctgtagctattattctgtgttaataaataagctaatgttatatgtgttttagaacctggttgcatcatttgtttattttattttttgagactatcacaaagcagcattttgtttacataattatttcagaatatatatatccctgtaatgcaccaatagaagcatagacggacagagagagtgagacagaatagcagaccagattggatcatacttatttaaaattacaaaatgtatatattatattatacatctgtactacacctgtttgcacgcacatacacacacatatatatattttccaattaaaaaacttagcgtttgagaggacttacctaaaacaacctgatctttctgatttaatttttaccattataaatcaatgcattaaatgcagaaaattacttcttctaaattcctgtgagttccttacagtactaaaattatttcattttctaggatcttctttcaaatcaaactttgtgccttaagcagctgctatagggctcaacttctatgtcacccaggtcctagcaggaggatttgaggccaggattgcactagctgtctgggttttataagcaaactttggaaaacataatattgtacacccttttactgtttctttttttttttttttttcagaaatgtgctctcctgaagaaaaatcagaaatacattgataggtatgactcaaattcattttatccaccacgagcctattcttgggtttaaaataatacagctaatgcgaattatctgtttttttttcagtctcttggtactttttcagagttaaatagtctacaatgaactatttagctctgttcttgaattaaattaagaacagctatcatcaattaaaagtacattctcttttacatcaaaataattttgtgaagtaaatttttacattgtaagtgaaaaagaccttgtacctgaaatctagtattgtagcattttagaggtgtaaggcccgttggagatgattagccttcccagaatgctagggatggctcaaatgtgtctcgcctgccttggaaagacagatgtccctgactgggcaatgcttctggttccctacattatttttcacttgtttgctgctagagacctgagttcatgtgggaaacagaattgaaaggatcctggttgactaggggaccagggatctcagtgggatctaagttagcatccagggttactcctgaacatagtgatctatgcaactctgtgggcgcactacttctcggtctttcctgagaaccacttgatgctcaagaagatcagttcttttctagattctggatctaaatctcatcttagaaggaatttaaagaggaattagaaagggttttgctaaagtgcttgggtttagggattagattcaagctgcttgaggaaggctctgttaagaagtcacattccagtccccaaagaataaggattgtggaaagtagttcattgaatggaactactcattagtaaatttctacccggcagaatctttctcttttatcactgtgacctccattgtttaacctattgcctggcatagaggagaaacccaatatttgatgaatgaataataagatatgacaacaagaaaaaaaaagagacataattcggtcttactggggagtaagttgcacaccaggtcttggaaatgaagcaatcactagaatggagaaccaatttagttctttaaagaatcatctgaagtgtgaaactagggctccctcagtatcttcccaccaactcatcttacggtcttgggagtccccttttagagatttactcgtgacaggaatgtggcagaagtgggactgccaagttcatcgtgactgcttctggaaaaacagaccatacaaagtaaaacaaataaacaaaatccaaaacaattacaaaacagcaagcatgggacaatgcctaaaaaaagatgtcatgttatgttgatgtaatattttcttatagttaaattattctcttaaatattcattttccatgttttataaagagatctatattaatgtattcagatcttttggggttatataaccaccttctaccttgaagattaaaacagggaccttccaaatcagtgaacaagaacaactttctgccacctacagaaaatcttgctgccatcgtaagaaatgacagacctgtaatatttatgccaaagatagcatttcttgggtcccaaatgatatagctggagtccctgtatttactggctttgttcctattgctaaactgtcttctattacaaataaaagtttgctttggctcaccttggaataaagaaaaaccattagcaaaaactttatgctatctcttgccctaaagttcttccagggggaagagtttggaaatctgttttttctctaagttgagaaggaatttgtcaagagtctctctgtggttttctggccaccatataaaaggtcatagaaattcaactgcttctgatgttgtcatcttgtgcctttgcatcccagctggaattttagtggatggggcagaaaatttttgatttagctccctaagcttcaaacgacatgcactattatggcaataacacatcctataatttgcttttatcaactaagtgattttccctctaaatgtggtatttgtctgacgtgcattgaaatgattgttgaagaatcttaatggggaattctggtttgcctttggcctttgacataactttttctcattgaaataaggatcaaggggagacttgattaataaactgtgggattaaaactttgtcttaacagaagttgtcttggaaacagaataaggagggatgccctgatgtgttctccacccctgaggcacctgagcggtcaccgtggagagagaagggactagagacctggagtcggtagagccttggttagagaaagacactgtttgttagaaaggaaattccttaacagttatttctgacaatagaatcggtgtccttggaatacattttctttgttgatttaaatattttactttttgctgctttagagtcaaattagtttggataaaaaaattcgatttgaactcagtgacataaagctggtcatttttaagccaaaaacactaactgaatttggacttaaaaacaaaacaaaacagaacttttcttcttcaaagatgctatagagctaaaaagaaaaaaaaaaagtgatattgtttggtttctgttcatagacgtaagctttgggagttaagtttttgctttatatatgtacaaataaatgaatccaactatcccatgtgatattcagcttgtggtagaaactccttttttgacttaaaaaggtaaagatcacttgttatagaaaatttgttattaatttatatcaagattataatgcctaaaaaatgtagtgagtcaaaagagataaatttgacattttagaatggtacgatcttgttttaactgcaggtgaagacttcggttactgagggacgtcgttttctcttttaattaatttcttttcctgacatttctctcatcatgaggcaaatttgtttgtggcacttaacctttaagtattatgtcacttttcactggagtcatgcagtgaccaagagtaagcgaatgtaagacatgaaaagttttttaagaaggcaaaaacttctcaaactaaatttgccaccagaaattttcttctcaacttgaactcagaactcactacctgaggtgctttttgtttttgccttcttggtcctgcttcccatccttcagagctgaggaaccctgtgttctgcaaatggcttttcaggctcaatcttccctacccattaaatgcgtatatattttttcaatttgcttttcccttcgctgttcctttcttagttcctgctgtcaaatcctacttattctttaagctcacttttaatttcctaacccctactttctcttctctattatcttccctctcccagttttggattattgattccttctttattctgaagcattcagtacctgtctgtgatacaacatttactctatgatatcatcatgtataatctgcctcccttccttgagagtaactgggttttactggcatttcagcactggggaggaaggaattacagcatctgacctgagatccaatttcttactccctttactgagggcaggggtaagagattcccctggaaaaaagacgaggcaggtaacctggtctcatttccaggatgatgatatttttggggagaaagagaacttatttgcacatagtccttagtaggatgtccctggaaaagacctatagtaaataggacccgcaaaatgaaacttagctccctggagaatgtcatctgggctatataacattcaagggcagggattgattaattttttttcttaaaatgtcggagaataaaaattttaggcatgtgagccacatggcctcgattgcaactactcaactcggattggagtgaaaaaacagacatagacaaaacataacaagtaaacctgtcagtgttccagtgaaataaaaatggtggttggcttgtgggtcatagtttaccaacccctgatctaaggtataaaatagagatgcttcagaacttaaatccacctgctgtgtggggtaatcataattgtaaagcttcacttggagaactcaactattgttctgggcagaaacctatgtccagggagggaggaagggttggaggaaccacactggagggcctgcatctctcactattctgtctctccttgattgcctgcatcctcacaatcattaataaagcttaattccaaaggggatctctgatttgtgtagacctgatttgacaattcagtcctggagattggctcaacacattagcaccaatgttgaacaatgcatatttggtgaaaagaattacgctggaacactcacctaagtctcctagtgatatttgtaccttaaacgaagagcttctaaatgcagacatatactgctgccctggttgggaatcaggtggcccatcaaactatctcaaggtggtcatggtcttctctaacttgtatcattgttgaaatccctcatttttctacaggcgttttgaagatgactttcaaatacatcaaggtcatgttactgattgtattttgctctttaaaaagagtcacttttcctcagaaggtttctctgtctgcaatataacaacactatagggattagtgtcctggtttcgtttggagagacctggttaggtttgacttttgacttggcatttcagttgagtatacaatttgagagatctttccaccttctttctttttcttgagagatgggatcttgtcctgttacccagactgcagtacagtagtgcaatcatagctagctatagtcttaaacttaagtccaggagtttaagactatagtgagttatgattgcaccgctgcactgcagcctgggtgacaggacagtgttcccgcctcagcctcccaagtagccaggattacaggaacaagccaccgtgcttggccacttctctatttgtttcttcttccttttcttagtggaagatttatggacagaaaagaggaaattgatgtacagaaaatcgaagtgaggtacggaagcagctggattagacatagcctggtgtttgtctcatttgatcatgctctttgagcagttggctataaccttttgtatttcttataccattccgaatgactcagaatctgaaaagaaagcagcagaagaaattactaatagaagacagggccctgtcttctgaagcactcctctcttaatttggacaaaagacataattaggcagatttggcactaaatcttgttatgttacaaactagctgtgttattctgaccaaaatatgtaacttctctgaacttgtttttcttctgtaaaaaggagaagtccacctttcacatgtagatttaaagagaaagctcatttacaggttgggtgattattcttgttctttgttggcctttagccagaagttatttgcacatgcacatatgtcactcagaattataatcaaatgttgagaagcctccactacagatgttcctaaaagaaaagggcagattttctctttctagtgtggtttaaaagcagttctactggaaggcagaaggatgaactggaacaatctctaattatcctttattgtcctactaacctgtctattttatctgcttctttttggcacaaatagtatctcacccaacatgattattctaggagaaaaagccactcagctagtgcccaaaactagttaagtgctgatttagtgagttctgaagggatatatggcttgactaaaattatttatgcagtcggggaagaaactaattcacacagcagtgccctaattggcatcagagaggtgtttccgtaaagcccttaggaaaagcaggaagttgattaaataggaaaaaaatgcacatgaaaataggagtacaaagaatgcatagaagaataaaatgcagttgttaaataatcaccctgataatatttcttccccccgagaagttacctttgatttaatgcaggagagagcacctgggaaaatttcaaattggagtccctcccacacttcccctgcctatactaagaatccatggcccagaattcaaatactaaatctaagagaggcaggtaaaaagaacagtggaaaacagatggcagcagttacaactagcaaattcccagttggtggctctcacatttagaagcgggcatctgttcttcttccccactgcaaagtggttttaactcagaggtgttaaaaatatctaagttgctgttttattcatttctgctatttactgactttaatgacttacagtatatccgatgaaaagtacaatgtttacccaagcggcaagagactcaaaacagaaatatgggatgctgttaaaaaaccttgtggtctacaaaacagcatgtatggttttataggtgtaccttgctttaagaaatcaatgggtaccttaacgtttgtgtaagttgaaatatactttaaaatgcaccttgggtgcttgacattacaaaaatcttgagagagtcataacctctctgggccttagtttcctcctctctgaaatgggaatagtaatgcctacattattaatctactgttcaggtctcttgtgaaaattagggatagtatcagttgaagatattataagcccctcaaatactgtaatgcttagtcaatgttaatgcattttattatttataaaaattctcattttgaaataaacatccattcataaaaaattaaaaatggagagtgtgcctgtgttcatgagtaagaaagcctcaaaaataaaaggggcagttaacataattatgaataaaatgtctatagcctctttatgttattgtaaagatgcctttcccagaaccatttataacaggtaccaggaagagagtcttactgaattgaatatcattcaacccattgcctaatgtagatatttattgactgctggccatctcatattttgttttcttcccttttttgatttaaaaatagtattcattcattgtaggaaatttggaaatacataaaacataaggaagaatagaaaaataatttataatttaaaacccagagacataagaccagtatagatcttatgtcaccacactgagaaagcaccagtaataagattaatttattaaaagcttttctgctctcataaaagttaaattgagtaatagatttatccaaagcatggtttgtaatcacagtttctgacctcacaatcactctgaatattcttcttcaatattattattaataatcactaaccttttctgagtaattactatgtaccagttgctatattaaggcttcatatatattaatcaatatgaaacgcacaacagcttcatgtatttggcaccattatctacaaacgtgaaaatgagaacatttgatattaaggaatatgcccgagggcccatggttaatacatggtacagctgtgattaaattaaaaattaggggtatttgattccgtaatgtacactgggatattctgcttctctttagtatggtggcagcagcccagattttggaatgagatatgttgtgggtgttgttgattctccactcttcatgtgtcttttcatgtggagggactttcctatccagtcacttcctgtgccttcattctcttctcttcatgtcaagaagactgacatcccatttgtgagtaaggaggtttaaactgggtgccattgccttagccctttctgctcttctctttatttgaggtctgcctgtgtgaagagaaggtgcattctcagctgctccttggcagtgcgggctgtgtgggtctgaccaatagtgttttggagaggagggtaaattcaattcagggaggcatgtcaccctatttctttgtacttaagttatctctttctgtttagccctttaccaataatcatatgtttaactctgatatatatttctcagtttgttacatacttgggcatagacagaagtgtttttaaattgattttctatgactcttagcagatagtcccagatacttttctaaccttcactgtctttgtgtgaaaccttgggcaagtgacttcactaatccatgtctcagtaccttcagttataacacaggacatactttttccttcctcatgggtttttgttaggtttaagtgggttcatatgtacaaaaaatactgagatattttccccattttgtgatgtgaacactgaggcttagagagtttcagcaacttgcacaggatcacacagctagcaagaagaaaggcaggcaccgcatttcaaaccacatctgaagttcatactctctcaagacatgactctgataattatgacaggacctggggtagagagcatggactcagatccttctgtaagagtgggccagtgtcaaggaggtcactaaaggacagcagaatgatgccttgaaccgagcagtacagaatcttacacaggttgtagaaataatgtcttggaagctgacatgagggtgctattttctttttgttgttgttgatttttttgtttgtttgtttatttaagaagagtgtttttctatcactttttctttttgaactaaggttgagatttttaaagtactttttttgttttttaagatagaatcacatagcttgtgatcaggttctcatgcttcagaatgctatggctgtgttttatttttccacttcctctaattagatgtttgaggtcatgtctccctgcaccactatcaccattctcagaccccattagtctcttctatccctgtcctcctgtcaccctcaactttgaaagcagtgtatccctgtccttttttttcaccctcgaactcgaaagcagtgcagtattgtctaaggaagcataatatgtagaaaggattagacacggtttaggggaaagtttggtgatgcatctgctctgagagtacagagaattggcttaaaagggcatcagagtaaaagaccagtttgcagaatgaattgtcttgtgcttgtgattgtctttcttgtggaaaaggccattttctcaagggacaacttgagtttagtcatcatttggaacaggtacagattcttacataaaactaatatacatgaaagcaacatttgttgagtgcactgtacttgatgttttgacccacattacctcaattcatcttcacaataatactaaaagatgaatattattatccttgcttttacaaaaagagaactggggctcaaagtggttgaatacttcgcccagggtcaggtactagtaagtgcaggcactggtaaggctcatgctctagtttgtctctttccaaagcctctgctctttttgctctttcttgcatgaattggtttattaaatatgaatgggggaagttcactagaaggctttttcctcaaaagaagcctaggaatcccttctctgcttgtaagtggacacattagtatgatctccatgtccatctataaattatctatagtatgatcaattctgaaattgggaaggacaaacttgggcaaatagctgctctttacagaaagtctaattggaaagagaatgactatgctctgtgccatgaagttttcaagagaaatgttgcaaggaatagaaatcttgatagatatgaattttgttttgaaaagctccgtatgagaaaatcttccacgagggacatcccttttaccaacttggcaaagactaaaaatacagagcatccaggatcaaagcgtattcgtgatgcgaagaactatcccctgacaatcaggctggaagaaggaggtatcctttaatcttttccctttgttttattactttttttttctgaggggaaaaattctcttttttattttctcttgctgactaactcttccctttagtcattttcatctcacgactcatggcaattttccctctttacattaagaatgaatataaacacaaatcacgtttgagtttctatttcagggccttgtttctctcctcaaatgttcagaggtaagcaacagaaagttggagtgagcatagcactaagacttcagcaggatcagaagtttccatcttccctctttgctctgtgcatgccagagttatggagaaaaatgtttcttgtggcaacaggaaagcagtttgaatcaatcaaagatcatttatagtttttataaactggagagaagaaataggcttgaacgatctttagattccagggaagttctataaagggaaccagaagtagttatttataaatgaaactcgaggtttttggtaaggggcttatgtgctagagattgcacagcttcattcaatgtgtcctagtttttaggacaaaagccaaaataaggggcggaggattattgcacatagcttcctgtctgggagtctaatatgggtgcacacattgatgccaaggttcgcttttgagttgttactttcaaaaaagcttcatttattaaaaaataaaatcatcattattatctcattacaatataggccctggatatgaaaaaaaattgattacctgatctttagttcccaactccattctatctctaattttgttgcttggggattattggtctatcaacactcttcctgaataatcaatctggttaatttagcctataaaccacttttccccttgtgtctggtgtaacatattgtttagtaatgtgcccagtaaagcagaaaaagtaactcccaggaatagaaaaggaaacggcactcagattttgaacttgagtatcttgcattttacccatctgctgggctgtgcggtaactcactttttatttattttgtttttagccatatgactaactctacctcattgtgctcagcagctgaacaaaatgcacagtgctatattctgaggcgcccactcattctttattgcttttatgacaaagctgtccctccacatgtctgctgtgccctctgacccaaggcgtttacttcaagtaaacatgccagatggtggagaaaagtgatgggtcaaagaacaatgctcgagggtcaggagtcaccaaatccttcttcacaaagcaaacttaaaagcaacaatttcaccaaatgctctggagtgctttcacagtggaaatggaggtgggaaaggtagaccttaattacatattttgctttcagggcctaatggttttaggtacagtgtctattggctaatttgaacgtaagcaatttatgagaaacgataagaaaacaaagaggacagatggatcactcttgtactcagcaaagagcagcaaggtgaatagtttgtgtgtgaatgagtattctaagctctggcccaaaaattacacaggtaatttagattccttatcttttctaggggctattgttgaaagttgaggcctaaaggatgccattgtctaaaatacactagaaccctaacaaggctctagtaacctccaaggaagcttttagatgagatcttccatttttttccttgtctagtatggtgctgcgtaaatccagatatatgagcatttgaggagttactgtaaatatcttaagcacgaggatgtgtctttttaatgttgctgttttcaaaagtaatttaagaaaatgttcattagccattttacaggctgtgtattttagaaagaacattagaaatagtagttactccttacagataatctggcataggtaggcactattacctctctttttcagatgatgatggcataacatgtctgtaaaatgcactggatttatacacagtatcctaatatatttttaaaataatttaaagagggaaaaatttttgaatttttcctgttcagtgcattgaaacatatccatgttcctaaaactctttctgggttaagtactatcatatttgactttcaagataaagtgtctctcctaattgccaagcgtaagaacttattttttgtgtgtggtaaagtgaattctctagctgggatatggtataaaatagagttaaattggaattcctaatggagaggttatttatagggctgaatgtgtgtccttaataagttaccaagattctgtgatagatcacctgtgaagagattggcagtaatagttacttttcaagaattaccaaattaacatttaataatattaataataacctccagttattggatgtcaactatgcacgagaaactttatgagctactttatgagatactttatatccatgcctaatttaatttttccaactttagccaaaacgacagcaagagagtttacaaattaccaattgctgggtttatcggtttatatatgttatctcattaagtcctcaaaacaaccctggaaagtaggtacaatcattagtgtcctttcatatgtgagaaaactgaggtttagcgagattgaacaagttatttacttcaagatcatacacttgataaatggcagacatagattgaaacccaggcacaagttcttacactattctatgtattattatctctactatattagtaataaacagaaattcagagatgttgcgtctgcccaaagtcacactactagcaggaggcagagggcacatccaaactcaggtttttttttctgactttaaagcccacactagatatggcagttgctctctcaatagagctacattcaaacaccctagaaaagtaactgatgttctccattgtttctgtaaaaggtacaaattgttactcactgcatcatcagtattcatggctagtgggctactttctgttatgcttgcacacttctgctcctaatcactgagttttgtgtttagagatgtgtagtttccaaacctctttataccaattgaacatgttactgtagttatataattatgttaattgtcacataagccaatggtaaatataaatgtggaaatagaactgttatttccatgaaacctaaactggatgaaaagacaataaagggaaggtacaaagatattcagccaaattaagtatgagtgatgcaattgtaaaagattgagagaaaataataaaatctgagacaaattcttcattcacaacggcttcccaattttatttaaattttgattccacttaaaagaatcccaagttcttgaataaaagaccttggttctaaatcaaactattggccaatgaatggatatacatgttagcttaaaataaaatatttaagttatatacttataattttctgattgcctgatgattcctgataagggggtttcttgtctgtttaaggtggcaaaacagaggtgcaggctgattaactcagtaacttagatcctgccatctagtacagtggcagagctaagacaaagtggcagagcaagaaacaggatttaactccatggctctgtttaactctatagttctccacagtttatgctttgtcttttactgcctcaccaatgtcataaatttgagggttaggaatcatatgccaggaaaccccatggaaaattgttgtgtccacatggacttcaaaattccccctactccattcccgccctgagaaaaaccttcctctttctcagtcagggattaacctatttgattttcaaaaactctagggaaagatatttcatcacatcacattatgattatcattgttataagaattttattttccttagagactctaccaatataccctcctgctaagatgcagagcttttaagcaataggaaagaacagaaatgacttttaatgacatgacaacattgctgaagatataagtcccagaacttctctaacttcatgctgtctcccctagctacttacttgacactttctgaattactcataactgaaaaaatacactgtgttttaggcttggttattaacatcacattagaaataatttatttaaccagtttctatctgttgaattaacagaaataccagctctcctggagaatttccagagaatgattcgtgatcatattttcttgagaattgaagtggtataatgctgaacaagagaataattgctatatatacagataccctcttttctcaggacttgtttatgtgatgtccaggttccttgtattagttactatggctgtgtaacaaattaccccaacttagtggcttataacaacaatatttatttactgtctttcctggtttctgtggttcaagaatttggttgcggcttggctaagctattctggcttagggtccctcatgagattgctgtcagatgttgactggggtgagtcatttgaagcattgactgggactgggagatctacttgcaaggtggttttctcacgtaactggctggtggtgctgattgcgggtgggaggcttcagttcctctctacttgggcctttctaaagggctgcttgagtgtcctcgtggcgttacagctggcttatattcaagaatccagtgtagaagttgcagtacattgatctagcctgagaagttatgcaccatcatttctagcatattctattggtcacctaggatcaaaaggagcaaggatcaggaggggactgtcttagaacctggctaccacaaacccctgctttgtccacctgggatcatggcaatgatcaaaatttgttattgtaatgatagctgtctgtcttctctttcagaatttaagttcctttactgtctgtgttgtgttacgtattttctctttcttaaatgcataggtttttagaagtctttttaactccttttcatctcttcactctgagtctggatttgatgactgcgttaattatttgttgctgcagaacaaaccacaccaaaccttagtggtttaaaaccacaattgcttgtctgcttataatcatgtgggtcagcaatttgtgctgggctaagttgagtggtactgtgaccatctgtcttgcctggggtcaatcatataacccaagtcatctgacagttcggatggagctagatgatctaagatgacctcactcatatgtctggtgtttggcaggttgtcaactccttgattcttcattatgtggcctctccagcaggtgagctggagctcattctcatagtggtcttagagttgcaatcgcatctggaagaggcaaaccccagagtgtaaacacatttcaattctctgcttgtattatgctagcaaatattccattgactaagggaagtcacatgggcaaacccagagtcaagagattgagaaattgatgtcacttcctgatgggagcattggcaaagtcacattgcaaaagggagagatacaggatgggaagaattattatggccatctgtgcaaacagtctgcccaaatagctttcctctgagcctttgggtaacctttctttatttgtatcaccctgtaagctataagctccctgaggcaagggccatggctggtttatatttttctatatatttagcacttttcccactgttacataaatattagttgaattgaaatgaatataaaaacactttcagggaaagagattgtggaaaaggcaagtagaaaataaaatggaaagactcatgctgtattgacaattttcaactggtttagttatttaaacaaagcctcaatccaagcatactaaaccatttgatttttaaaaattacattattagttgtttgcctgaactcactacctgtttggtcaaaaagattggataaattgtgggtgtgtagataaaatacaagtatagtatgccaatcaacatcacacgttcatattgctggttcacattagatgctcaataaagcgcagctgtgacgtctcttgttcagtaatcatgggactgctcctgttgccaactttgcctgtagttcaccaaagtcaagttgcccacggtaagataatttttttttaagattattgttgataggttccaaaagtgtattaggtggttaaattcctcattgttaccaatggattagtgagtcaagcaataaacattaacttattaatgtcagtaacacttttactttcagtattcaatctagttttatttatgttttatcatctgtggcagtagttttcaaattaagagtatgtaaatattcaaaatattttgttctcagagtcggggaggtaatcaaaaaatatttttgataaggctgcatagacaatccaatattcccaacttctttgtgtttgactagaattttattgactagaattacagtgtgtcaatttggattatttcgtcctgatcaaagttatggaatatctgattaatgagaaaaagaaaagcagattgatgtgtatatattgtagcttattaagtagatcaactctttcgaagcatgaagcccatggaaagaaatagtaagaggagtttactggtgaaagctgagagactaaagtctgtattaagttccttaacatctgggtggtcaatatggttgtaagtaataggtcttatgagaattatgcaattaagatagttataatggggacgggtgtatttataatctactgttatttaaaaaatattatcccaaaatttagtgacttaaaacaacaataagcatttattatcctacatgatttttatgtgtcaggtatttagacaaagcataatgggatgacttgtctgtgctctatagtggctggagcctcagctgaaagaattaagagtcggggctgggaataactgaagtcttattcattcatgtggttgatgccagaggatctctttggacttgttggtcagaacactcctacaccctacacagcctcttcctgtggcctgggctttctcacaaaatggtggttggatttcaaggacaaagagaaagagagagagataaagggtgtgtgtgtgtgtgtgtgtgtgtgtgtgtgtgtttgtgtgtgtgtgtgtgtgagagagagagagagagagagagagagagagagagagagaagctgtattgttatttatgacctagctttggaagtcatgcattatcacttctgctgcattctaaccatgtaggcattcataaaggccagctcagttctggggatgaggaaatagaatcagtttcttgacggagagtgacgaagtgctggaaatgcatatggaattagaaatattatggccagttttggaaaatataatctgcacccatggagcaggagtaatcatgatcacattgtgtgtgatcatgaaatcttgctagggtttcaaaaaataattatacgaaatttttgatctgtggtctgaataatgaatatgattggtagtactgagcatagccaaggatgttgactccagggggatggtattaattaaaatatctttcagataattcagaaaatataagcaaaatgttttgttatattcatggcatgtttttattgcaggtgacaaaaattgaactcaaattggttcaatcaaaaagagtgaatttattaacttgtataactgaaaatttgggggacaatgctagctgagagtacaagtggataaagacctcaaatgatgttggcagcaggaatcagtatctctccgtatcttagctttgcttttcagtttttattgcttaggcaggcttttctcaatcttgaaaaaagaagccagcagcaattctaggtttatattttaccagcttagcaactcccattaaaaaattgtctctttttcaataattccagcaattgtttggagtattgagactgggtagactctgaaaaggtgattatgattataccaatctttgagtgtttatgactttgattagtaaagcttgaaccatgtaacatccggagggctggaggttggggttggcctcatctactctcatgaatcaagaggcatgatgtgtgtaattggtatatgcagagaatgcctttcacagaaactgtggaaatataatactgacgaattgatgtgggcactgggtccctgacgaaagagcactttctggctatgatagacaggatggctttggaggtcacccagaaaagactgaaatccccaaggatcaatgctacagggaagaaattgagagcctatgcttgttgattgatttaataagttatatatcaatctgacttcagtcttatgtatttatttgacacttagttgttaaacatctaatatgtgccaggaatggaattttacatgtttggctaggattgtaattttagtttaagtgagaattagaattgtctgggcaggtctggcagaggtgtggtgtgagttagtaaaaaacaattgtatgaggacctcagagcctcttgggaagtacatttgagggaaggtgaaagtctttgaagttggaggagagaggcaagtgcagcatggtgtctcccattcagatcaattccctagcccagttagccttgatttgtgtatgaaccccagggaaggcagtgggattagaagtcaatattgaaggagctgtaagacaaatggtaacactgcactgcaacctccttctgcagagagaaacccgaaggagagagaaacattctctcactttgctgctgaatagtcggatggctttggtatcttgagaactacagtgtctgggatatggtgggaaaaaatagctcccagtaaactcctaacaggcataagtttagggtagagagagagtatttatttatgaagttgtggatgatattctttgggttccttcgagaacacgtgggaccattgcttttttagaatgggaaagtgatggtcagtaccataaaatgtaggtttttacaaataagagggacatttgagttacatatagtttggtatagttcagtaatttccagtactattggaatatcttatttgtcctttattaatacaaggggctgtggagtggactggacttaagaaggattaaccttaaaaagtctgatttttggactggtgcattaaaaactgtaataacatccagggacatgttggaagtagacaccattatttctcaaatatactgattacataatctgcaatttaaaagaagatggccataattatctaatggatttttgggaggctatgtcagagatgtctggccttgtaaatgatcccacacagaagatgatcaaatgcacttctctctgaactgctctattttcaaatttattaaggaaactaagggagcttaattagcatagtggtaggccagaagacataaaataataaaatgttgagattacagaatagtgggctgtaataaaagtatgcttaaagtgtaacatagaggaataaatggaaataggcaagttcacagaagaagacatttgaatttggctttgaaagatgatttgaagttgactagatatagagataatgaggaaagaccatccaagttggaggaaacagaaatgcaaacacatcaataatcccatgtttggaacaatgtgtaatcttttatatcttgcttatgagtttaaattttatcttgttagacgttaggagtcacaaaatgatttaaattgaagaatgacataatttgatctttgtctcagaaagattgctttgacataattttggaggtctggagatagagaagaggagaaaagactagttaagcctgtcattcataagcaaggctagcaaggtcaaactccaagcaagaaatgatgaagactttgatttggtcagtgatggggagctgagaggaagtggtgcatttttgagaaagactgatgaattgtgtattcataaatcagataagacactgtatatttctatttacctaatttttattatatgtactttaacatagttttatactttagatggttggatgtgttatagcaaaggactcaaattgtcttagtagatggtggctaaatattcatcaaatagcaatactttctgttggggtttgctcttgagtttatttcaaattatatgaaaggagagagaatgaatgtgaaaaaggaaattagtagtctactgtattttaatatagcatggtttttatttgaatatgccaagaagatacagagtaattgacagtctgatttatttatttatttatttatttatttatttatttatttattatactttaagttctagggtacatgtgtacaacgtgcaggttagttacatatgtatacatgtaccatgttggtgtgctgcacccattaactcgtcatttacattaggtatatctcctaatgctatccctcccccctccccccatcccatgaccggccctggtgtgtgatatttcccatcctgtgtccaagtgttctcattgttcagttcccacctatgagtgagaacatgcggtgtttggttttctgtccttgagacagtttgcacagaatgatggtttctagcttcatccatgtccctacaaaggacatgaactcatccttttttatggctgcatagtattccatggtgtatatgtgccacatttccttaatccagtctatcattgatggacatttgggttggttccaagtctttgctattgtgaatagtgccacaataaacatacaagtgcatgtgtctttatagcagcatgatttatactcctttggctatacacccagtaatgggatggctgggtcaaatggtatttttagttctagatccttgaggaatcgccatactctcttccacaatggctgaactagtttacagtcccaccaacagtgtagaagtgttcctatttctccacatcctctccagcacctgttgtttcctggacaatctgattttttaagagaatgaatgaaagcgttcaaataggctgccctttgtcagaatttatgtaagcattcagattcttaaggttgtgttattatacaactagggaaaaattttcaatgtcaaaatgtgatttaaaatataaatatgcacttaaaaattttggaataattgacatattatatgggaaagccaaactatgacagtattgtgaccttcttagctctatttctgtaatatttccactctcggatcaatcaagttcttcaactgaatgtttagttcaaacttagattctggagacagtcctgtttctgatcggagaaagttaagaaacctgaggaagatagcttgggaggacctatattaagtgtctttggacaggtatagtctgatctagtgttcttgatttgtgaattggaatcctgataccaaactctaacttgtgtctcagtttcagtgacgtgttttaatttttgtcctatgtcttaaccctgctttgataattcatctagtattcctgctacttgagattataactcatactttatgtctatctagaactgaagtcctcaaaatctggggccatgctatctgttactacgactctctgacaatccaactacctttgtccttgaatcagcggcctccaggtgtcaccctactctgtacactgtctactgggagattcacatctattctatactagtagctggatcttattgctggtctcttttgacttgttctgtccatttgcagactgttctctgatttcaaaccctaacagaccacaatctcctatatttatgctaaaataatggttttcaattttccccaaaatctgtggaaatggttcaagtagtctatgtttatatttaataaaattttacttaactgtatttttaattattatgagcccaccccaaagtgtcaaccctatggcaataaagcacagattctgaagtcaagcttccagggtttaagtcccagctccaacatcactcacttgagtggctttacagaagttgattaacttttcattattttagtttcctaatctgtgaagttgttgtaattaaataatttattgtggggtaaaataagattatttatgtgaagaactcatcacagtgcttgaaacattgtgtcgcaaatattgttatttcccacctaataaccactcttactttttccttgcaaagagaacccaatgttgttctggctgcaacagccccaggagttaagtcaggatttgattgagctgagataggatgccacttcacttcttcagtgggggatctagggttgagtgtatgaacaatgaacataaggaaaagtcttcttttcaggagttttggggaaaagcattactcactaataaaatgtgaagaggaaagaccttcctaattttgctctgccctctatctttctgcttcaaattctgtcattggaaaacttgccaagtagagctacagcatccatcttgcaaccctgaagcaccaagatggagaatgaacatcaatgtgttgaggatagtggaaggatgggaaaagcctttctctatgatgtcattgttgagccactgagccaattaaagacatccaaattgtggacatttagttaaatttacaaaagttattatagcctaaaccaggcattggcaaactatggcttgtgggccaaatctggctgtttttttgtttgtttgtttgtttgttaaataaaattttattgcaacacagccatgcccattcatttacatgttctctgtggcagctttcatgcttcaatggcagagttgtttaatggcaacacagaatgcatagcccacaatgagtaaaatatctacaatttggccttttgcagaaagagttgtggacaccttgcttaaatcaatgttaattatattgtcttctgtttgaggttgaaagcatcataatggatacattgaaaacttttaataaatattaactattattgttctagtaaaaaacacacgtgcaatggagtaactttctttttcccagttctagataaatcttctgccatctcctcttatttgaagagtatcctgagatggtgagaaaaatagttcataataaacaaaaaattctgttcccactttgcagacattcatatgtgggaattgagacttttatttataccataaaaccgaaccgaaaaaaattagaaagaaattgtatgtaaagcttatctagggctgcacctgtcatatgtacttctgatttcaaaatgaatgttcactaaaatactttcactttcgccattcattataaaagtggttataatgcataacattataatgagtattttataaggaaatactacatacattaacttgtatttacactttaaaatagtcatctattttacattataggacaccaagcaatattgtacttgaaaaaaattgaaacaaattccattcctcaaaacacagttgaaaaccaaggatgtagaaatattttagctgcctgtttaactttgaaatctttaactttgaaatgaggccctcttatatgaaggacctcttcaaggagaactacaaatcactgctcaaggaaataagagaggacacaaacaaatggaaaaacattccatgctcatggataggaagaatcaatatcgtgaaaagggccctactgcccaaagtaatttatagattcaatgctattcccattaagttaccactgactttctacacagaattagaaaaaactactttaaagttcatctggaaccaaaaaagagcccatatagccaagacaatcctaagcaaaaagaacaaagctggaggcatcacgctacttgagttccaactaaactacaaggccacattaaccaaaacagcatggtactggtaccaaaacagagatatagaccaacggaacagaacagaggcctaaaaaataacaccacacatctacacatccggtctttgacaaacctgacaaaaacaagaaatggggaaaggattccctatttaataaatggtgttgggaaaacttgctagacatatgcagaaaactgaaactggactccttccttacaccttatacaaaaattaactcaaggtggattaaagacttaaacataagacctaaacccataaaaccctagaagaaaacctaggcaataccattcaggacataaacatgggcaaagacttcatgactaaaatatcaaaagctgtggcaacaaaagccaaaattgacaaatgggatctagttaaacgaaagagcttctgcacagcaaaagaaactatcatcagagtgaacaggcagcctacagaatgggagaaaattttgcaatctatccatctgacaaagggataatatgcagaatctaaaaggaacttcaacacatttacaagaaaaaaacaaaaaaccccatcaaaaagtgggcaaaagatatgaacagacacttctcaaaagaggacatttatgtggccaacgaacatttgaaaaaaagctcatcatcactggtcattagagacatgcaaatcaaaaccaccgtgagatatcatgtcatgccagttaaaatggtgatcattaaaaatccaggaaactacagatggtggagaggatgtggagaaataggaacgcttttacactgttgttggacatgtaaattagttcaaccattgtggaagacagtgtggtgattcctcaaggctctagaactagaaataccatttgacctagcaattcgattgctgggtatacacccaaaggatcatgaatcattctactataaagacacatgcacacatatgtttacagcactatttacaatagggaagactcagaaccaacccaaatgcccatcaatgatacactgcacaaaaaaacgtggcacatatacaccatggagtactgtgcagccataaaaaatgatgagttcatgtcctttgccaggacgtggatgaagctggaaaccattattctcggcaaactaacacatgaacagaaaaccaaacaccacatgttctcactcataagcgggagttgaacaatgagaacatgtgggcacagggaggggaacatcacacaccggggcctgtcagggggtggggggctaggggagggatagcattcggaggaatacctaatgtagatgacaggctgatgggtacagcaaaacatcatagcacttgtatacctgtgtaataaacctgcacgttctgcacatgtatcccagaacttaaagtgtaaaagaataaaaaataaggccctctttcttaagatctttgtttagtgctggagtgttttttttttttttttgtatcttaaacctattgaaatgcttcacaatttacttaagaaaaaggcacctatcattctggttatctactcttaaaataccaaaaggtatttgtaatagaggagtggtaagtagtcaagttatccctaccacgaactgctaagggaccttggtgaattcccttcaactctccaatcatttctttcttatggcaataccttagcaggtggtgtgaggatcagaagatagtggtttcttagtaaacacttattatctaatttcataatggatttgacactacacttatgatttatagcacatgtagaggttttgatgattttaactgcagattgaaaaaagtggagtcaaataggttttttttgtatttgtttttaaagcctaaactattgagtctataacaggaaaagaacattataaaatgaatacgtgattgatcaaaaatagcacatgtcagtaccccaggtataatagaagactcttgattgcttatgacaaaaaacaaacaaaaatactaaacttggttttagaaaaaaaattcaatggcagataagctaaaaaacacctagggtataggtctgtgagggctctgtggcatggttagatacaggggtcaaaaagcacttttatcatctttctctctttttctcctttcctttttcatttctttgcttggctttctatttattgcttgacttttctctgtagtagctttattcttacctaggttttcttcctataatgacgtgtggtaagtccaggataacatcccacctatctagcagttcctacagaagtccctggttatcatcctcatcctcctactgctatggacaaggagacctagttcacatgtccattcctcaaaaccagttggtaggcctgccccaaccaaatttcaaagacttagaacagagtaagggccggccttgcaaaaggagaagttagcttctggcacaacaagaaattagaatgctgtgaagatactcatatctctcacttgctgagtgcatgatcttggacaagttatcaatctttcttcagctttagcttcatcacttcctattgataggaagagttactccagaggtttaggttgataattcaatggcctaaggtattagagagtgtcctagagttgctggcatatacccagctggtaggtacccttattacatctttccttgctttcagtagcatggaaataagatttcgtgaggaagccgagtgtaaaataggagctgctctgaaattcctaccacaggatcactttccttttgatctcatacatttatacatggaaatcatgaaaatccgtataatatttcctgtaggtctaggctacgttaatgcagcaagcaaatataacctggggataaggtggataattcagctcttgtagtccgttaggaacagtcaaataactctatttatcttcctggtagaagatgtctaaacctaactgtcatcagggataaaaatgcccgaaggtgctcaatacctgttacctcccacagaatattcgccaccccgggcataaaagtcaagaggactgtgggactatcagtcaatgtgttgattagtaatctgctactctcctgttttgtcctgttaatgtgaggacaaaagctgtggtagtattgatacaacctgaggaacgcacagcaatttcaatgtgtcgttcgtcggaatgaagccatagctatgtagccttacaagtgctaaaagcaattagttgtaactgatcttgactatcaaagaaatgcatgggaggctggttgtgtggtgtggtatccttttaattcctgattgatttttgctgtaggttattttttgtaatttttctaataacaaacactgggtgacaatagcttttcttcaagcatgtattgtgatctttcgtttcttggtcctgacataatccattagtggctacatcacaagcctggatagaaacacagagcaggtcaagtcccattacaataaaaacttttgtttaacaaaatggttcccaagtccttctgtggcagaattaattcaggcagcatgaaataaagtattttggtatcataaacggtttggattttctctttgaattgctcttaagtaattatgaaatcattcattgcttattcaataatttaaaatatctactgtgtctactgcttgccactggggttcatggcaatgaacgaaacatctcttctctgagagacataatattctttaggatggcaaagacaattggattagtttactgagactgccacaacaaaatgccgcagtctgggtggatgaaacaacagaaatttatttctcacagttcaggaagctagaaattcaaattcaaggtgttgacagggtttgttctcctgaggcctctttccttgacatgcagatggccaccttctcactgcgtcctcacacggcctgtgtgcacattccctgctctctctctgtatgtccaaatttcctcttataaggatatcagttagaatggattagtgctcaccttagtggcttcattttgacttaatcacctctttaaaggccccacctccagtgtcacattctgaggtactgagagtcagtgcttcaacgtatacatctctgtgggggtgcataaataatctcataataatgtaaattaaaccagtgagtatgtatcacttaagctggtaccccaaaactataaataaaaataaggcagggtaaatgattgggtagaatgctggggaaattgttttaaacaggacagtcaagaaaatcctgtctattgaaatagcatttgaacagagaaatgaagagaaggaaagaagaatgggaatatttgggggaaaagtgttttaggcagagggcattgtgttcagtgtagtagaaaagagcctagaggctgatatggctggagaggaaagtgtcaggacagagatgagagcagaggggtaactggtgatcatcatggaaagttgtagaggcctgctaggaaagggtaacaatctgccggagacaatagattcctaaacccacaatcaaggctcagtgtcttatatgctagtgtagggccgtgcggggtgttgtggacaggactggctacctaatttgtagggcccagtgcaaaataaaaatgtggggcatcttgttgagatgtgaagatggtgacatcagggtattaaaccaaatataggatcattctcatctcagagctctgtgcaactgcacaggccacatgccctggctgtggaaacataagagaaaaatctggatttacatacatgcttcttcaaaggtaaaatgtgtgttcagaagctgggtagtcttgtggaaagtgtgtttctgtggtttagatttaaaatctcagttaaaatcccagcttctttgctttctaccagtgaaaccaactggttacaaatttctcatttgtaacaagacgatagtgaaccatgtcttataaggtttggttttggtccaattttgccaaataatggtaaaaaatgttgggtaaaatacaggattctctcgtagtccattttgtgttgctataacagaatgcctgagactggataatatataaagaaaagaggtttatttatctcacgattctgctgggggaaagtgctggcatctgctaggcttctggtgagagccacatgctgggtcaaagcatgatggagaaggtcaaaggggacaggaacacgtgtgaagacccaagtggagtcctggctttataacaacctactcttgcaggaactagtccagttttgcaataactcactcactactgctagaatggcaccgagttatttataagaaacctgtcctcatcatccaaaaaacttccactaggcctttccttccaacatcaccacactgaggataaaattttaacatgcgttttgatggaaacaaacaaatcatatctaaaccatagcatattccataaaaaatcatcaagtaatacatttaatttgcttctcttttacattctcttttgacatcacttccttcctataattcctgaacaaggaaaatgttttgtgaactaatggtaatgatttacactggaaatgaagattattcacctttttataaatgcaggaaatcagtctcatttatatgatacattttattatgggcaagaagcccaggtgtcagatagtgtttgctttgtcccatgacataaccgaaagtgtatgttgatggtctttattactctgcagtaattatttggtaaaatgagccaattctaagtgagcctctggtcttggcctcatcccttttgcttcttccccgcttagacagtcattttcctgtccttcttgcccaactttctccccaaaaagcagctgtatttgtgtgtctcatcctgagagggcaggcaactggctgctatcaaagtcactctgtggcctggccagtggggagccatgaagaaccatctgctgcagaaattgagtgtcacctctgcagtagtcttgtttacagaaagatcatggagttattcttaaacgaatatatggtttgccaaagaaaaggacatagttttaagcagtaaataaggagaaagctgtaacccatcttggtaagcctgcatacttagctgcatggaaatagtttttctgtaatcatgagcaatgacagcgggaaggcacactggaaacacacctcctattgaatgcagtctcaaatatgaaaacataaatgacaagaacacctaacttgtggatgaaaatcaacaaaagtatttgtaaagtttgtattaatcattttaactctcagagcctccctttgtagtatcatcccagtcatatctattgcctctaaggctccaattgcagggcgcgttaaggaaaaagcatgggctttggcaccagactgatttacattcaaatcctcactttacttactacctgggtttacatgaacttgtcaaaacctcttgcgattgtttcctcatctattaaatgggcatcataatacctactttaaagggttgttggaaaatttggagacaatctaatgattatcacaggaagaacttgaatgtagtagatgatcaataatcattaggtattataattagccaatattaagatgattgcttttcgttattcttacccatacatgagtacaataaacttactacaagaaatataggcatctgactaaacatacagttttaatggtggttgacaacacggcttaagttaactcttacttgaatacaatacaatgcacgtttttaaagtgccaattatgggaaaatcattgtccttgcattgggaggtacataaacaaaccctgaattcaaaagttggtggaatgatcaagacatgaagctactgaactgttaactattttgcaaaaggacaacagttcatttctctataaaatactctttgaattctttctgtaggacatgttgatattttagttagtcatatttcttgatcatagctccactgaaaaacatttcataacttggttaggattcaaaatttttatattattttctttttggaagctgtctctctggttgagaactcattaaaaaaatgtatcacatattcttacctaaaactgagatgtatctttcttgatactatttctaaatgaaagcatgaagatattgaacctagcctggtgctataggaagagaagaaccacaggaggtatgaacaaaaataagaaaaagacaaagagataagactttaaaatgtcaagaaatgaggagggaataaaaggagcagctttagaaagaaaatgatgcaaaaactggaaaaatatataagggaaaatgaaaggcaaaagaaaagttaagtaaagagaaaagcaggtgaaaagggaatttatgtcagaatatgtggccaagtcataagatctttgtcttacttttggtctgaaagaggattttcttgcttgaaaaaatatttttaatccatgacatttgttttttacttacatctcttagaacatttgagaatcctggccactgatatataaatctatagaatcaaacaaattttatgtaattcttgctatttttagagatctgctgtttgatctcctttgaatataatattagcagtagatttcattaatgaacactgccattcacaaaacagtcccctcttccagtggggcaaaattaaaattgtattcagctaaatgagaacaccaggaatcactgctgctactttgataaattgtgagactgttctaatgataaaatactttctagttctctttataaacagtgggctctcatcctggaaattccaagccctcactgatgtccaaaataataagcacaattggaggattggagaccatttttctcagcatggagatgtactcttatttctcatctcatgttttaaagtgattttcggaggttttcattttgaggcatagattccgcaataaagtgtagcacatcgttgttttgaccacagtagagttgtgtttttttaaatgcagtttgttccatctttaattttctaaacaagattctgaaaaaatttctgggaagttttcaagggaatgatcttacatcttagcattgtgtggcatttacatttgtataagcctactatggctctgaacagaaatctcagtgagtcaaagaatagggtttcttttaaaatgtgtttatcaataaaataactggaaaataagtttcctttcaaagttttgaaatgacaacaacatcctatttgtcatgaacatgtctggctggttaaaaacaaatagaaaattatttttatgtgtcttcaagatacttttgtaaagatattttaaatttgtatttattaataaaaacccaaagttagaataccagtaatgcttttttctaccaccgttattttcttctagaaaatgcatatgattaaaagcaaatttccctttcttctccttagaatactgctttccttgatattaatctgaccataaacaaagctatgagacactaaatctgtttcttagcaccaaagatacaacacagaaaatcatcaagagatcctcaaatcaaattttgctttggctatcaagattggaaaagaaatgataggaaaaaaagttcaaagccaacaggaagctcttagaagtcaagtgttattattgtagcgttatcatcagtctgattcattgcagtagtaatagttgaaattgtttataatcaaagagaagaatggaaggaccacgtcatcgaatattttgttggggctctttagggcttttcacatggaagatatgtattatataaaatatactagtaaaaattgatttctcacccttggcactatgtttttttaagacctgttagcatatgtattattttaaaaagtaattggctcctaagaaagtaacagatttcgttcaatagtcttcttttgagtattaatatcctgattaaacaaaaaatcttcatagttcagtcccatgaacaaagacttccctttaaaatgaacattctgtatcaactctaaattaagaacttctccagattcaaactctgaatggattgtgtgacagagaatagaacatggactccttaatctctattcttttccttgtctattctaatttacttggttgtatcacattcctaatttccctcaaatcttagggaagacaggaaaaatggtcaagttagggaagaaacgtgcagacatcttatatggagcccatagaatggatgaaaaaattagagaacaattttaatttaaaatcagttcagctccaaaaaggaaagggttaagccgagaagggataggtcttggcatgtgagacacgtttgtttggatttgccggtcatgaagtatttcccttagttggtccacatcagttatttatttctcataggttattctgctatggacatggtcagtgctcttgtagaaatgctaagatttttgggtgaggcaaatgatatcctctctacaaggtctctattggtagcagtctgtggctactacaatgctttcttttctaacctgctttccttatctttgaattttggaatgctgctctgtatacttggttaccaagctgatgtgtgtctctggcctggatgcttgcttctccattaatactgcttacctgttttattccacaaccttaccttaaactctgatacagttgtgtcctgattcctgatgtggtttttcaatactttatttttctctccacatataacatacctagctgttgagtgcctgggttctacctcaactaataacttccaggtattattctgctctgatattctgtctcaagctctagctcttaccatatgttacttggtctctgttcgttaccttctctctgagttctatttgcctcctagagtttcagaacaaacatttatgaatacgtatggaaaggacttctgggttccataagaacactgctttcctccttatcaagaagccttgaacaaatttttctttgtcttatagctggtcgaagtctgactgtcaatacaatcatatttattataaaagataagtcccaaagggtaaatgtttgggtttgatgctacagtcttctattttgtttcttctaattaataaaactttgcttcagacatggtgtgtgggaactgtgctgagtctgaggaaaagctgataaatctctgaaaaaaattgtgttataattttgtatagtagtgatattgctgcagaaaaacaggtgccaaccaaaaagcctagctttgaaagaaagcttcatggttgagttatgagacagctggggagcagcaaaatagatatggatccataagccctgcaggaaaaacaactttaatcagggcctgacacatttggtgattgtaacgaagtctcttggtatgtgtaagccctggatcaaatggcaccaattggctattgacaagcgttccattagtgcaaaactggatgaaaaactggccgttgccctgcacagactccaataataagaaatgaggttcttgtacggaaagggacttagtttgttttctaaaaacatatgtgcactggcccaggtgatacctctggtggactgaaattcctctaagctcagccttcagatactacagtggcatttagtgaaatctttccaagtctctccaagtgacaggcctctttgactccttaaattgattccatggttctgaataccagtagctaatgctgacagtttgacccaggagcagggagcgtcgtcctgccctgagagcccctcaaatggattttacaagggagtggtggatattacgcttctaggtgcggtgaagcgtgtttctagcactttccacagatcataaattaatttgaaatgaacttctcccctcccagaaaacacaatatcagagaaggactgtcatcatggtttttctgtagcatagtacctgaggggggaaaaatcattttctcctgcatttgttgactggacatgtgattggtgccaaatgctaggctgccacaaatgtgtgccatgtgtgtccaattcaaaataatttgcagttcggtgtagattctccacaccgtcagctctgaaactgaaagactggaaagagctatgcatatttttttctaaagataggtgttatgtaaagccccaaactgatgtttcagggaccccaaatgtcctgtcctcactgtttctgtaagtgagtttaaatataagtgactattcttgatagttacctgggaaagataagaagtagtttgtaggacatgcagtcttattttataattatgtgtgggcatttggcaaacaattataaaataatatagtatcctctctagtagtaatgctgcgaggtagaaggcataaaaccaattttgttcttcagaacttaaaattcagtgtttctttcacttgtgtgtagcacctgctgttttatatatgataaaattttacagaattgattatattaaacttggttgatgtcattagtttactttcatattctcttttccttagtatatagtaggacccatagaaaacatatatgattaattgtactatgattgaaagtgactgtgagttaaagagaataggaaatattgaggtggaagagaaaggagaaaggaaaacaaaagggagatgtgtgttagtaggcaagtatccaggtaattcaatatcaactacctttttagtggccttcttttctcctgcccagattttctcctgatctctagaacttaacatctaattgtccatgggctactcttttagtatgttccacaggtgcctcaaattcaatgtccagactgaactattcattttcgtacaaatatgtcatccctacatagttcctgtcttgaggaatggcactactattctacccaggagtcatctcagatgactttgcccaccttctttgtcacttaatagttataagcagttgtagagttcatctccaaaattccctgcacttttatagccaagtttcctgccttagcagttctcactggattactaggtgaatggacttgctgactccaccaccccactactttaatttagcctttactctgcagccatagctttttaaatgcaaatttgatttcatcactccactgattaaaattctttaacagtccttttagcccacaggataaatttagcacccaatattctttatgatctagctgtacatgcttctctaatctgatttcctaacactacaatctggggtctatttattatatgaaaagcagttttcaataaatatggtgctgtttcatgtttccatgtcattgcatatttgattttcattgttgggaatgcctttttgtgttgtttgtttggcacttggttgggggttgcacagttatccatagtgaagtcacatttcttcatctgcgaagcccctcctggacttattagtttaagttatgcttttactctactgctcctagaatcatgtacataatcctaacattgtgtccatccatgttagtttaattgctggtttttctgtgtccctcatttattctaagctctttgggttgagaacagtgcttttaacatttttgaggctctggtgcagtatagtttctggtatatgatgaatactcaatgtatatttattgaatgaatatacaaatgcaatgataaaagcacaggttcattgcgatgatggatgaataactcccagtttggagaaaacatctctattgtttgggggcatttggcaatgcatagacttaagagctgaaagaagatttgatcttaattcacatttgatttgcacttctggggcatattgatcttgaagaagcccatagcaattggtgactactgtaagggaatatagaaaaaaatgacactcacgtgaaaaactgaagagagattttattttgtcctttcagtctttgatgtattgatacacttaaatttccctcgctcttttcctttctaccttcttccctctctcccaccctctatagcttcttccaaaagaagtataaaatagttgtattagaacatataggtttattttaaaattatttatatataaatatatgaataaatacatatttagtcttaagttgactctgttaatatgtatgtatatgtataaaattttaaagaattagaatgtattgtaattctatgtaattacatataattctatgctgatgttggtaaggatcagaaaaggagtctggaactggagagggagaaaggaagtcacgtaatggcaaagccagaatatgtattttgagagccagtcttaggggaagtggatgaagcagaggtaaagtgcatgggggaggcagaatgcacagggccatagaacttcattcctctgcctgtcaagggggatttggctagtgcaagggcagaaagagccagggctgagtggtacacagggttcctatgtgttcagcctggagataccatggacagaggtaaggccggcttcctttgtggattaggaaacaagggacgtgaaggacctcttcaaggagaactacaaaccactgctcaatcaaataaaagaggatacaaacaaacggaagaacattccatgctcatgggtaggaagaatcaatatcgtgaaaatggccatactgcccaaggtaatttatagattcaatgccatccccatcaagctaccaatgactttcttcacagaattggaaaaaactacttcaaagttcatatggaacccaaaaagagcccgcattgccaagtcaatcctaagccaaaaaaacaaagctggaggcatcatgctacctgacttcaagctgtactacaaggctacagtaaccaaaacagcatggtactggtacaaaaacagagatatagaccaatggaacagaacagagccctcagaaataacgccatatgtctacaactatctgatctttgacaaacttgagaaaaacaagcaatggggaaaggattccctatttaataaatggtgctgggaaaactggctagccatatgtagaaagctcaaactggatcctttccttacatcttatacaaaaatcaattcaagaaggattaaagacttaaacgttagacctaaaaccataaagaccctagaagaaaacctaggcatcaccattcaggacataagcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaatttttcgcaacctacttatctgacaaagggctaatgtccagaatctataatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatatcatctcacaccatttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatatccaaaggactatgaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaaggatgatttcacgtcctttgtagggacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggttgggggcaggggagggatagcattgggagatatacctaatgctaaatgacaagttagtgggtgcagcacaccagaatggcacatgtatacatatgtaactaacctgcacattgtgcacatgtaccctaaaacttaaagtataataataaaataaaataaaaaataggaaacaccgtgaaaaaaactaccattgggtacacatggggaatgtctttttagccataccgaactaattattaacataagaattcccaaaagctttttctatctcacctatgctctgctgatactctagagctctggtagtactgagaatgagcggtcaacatgctagatatcccttctcttgtaaactcagcttcttgggtgctctcttaaattggagagcatacatctagggaagaaaatgtatccaatgccttctgtgatgccgggttcatgaaaacccaactgacactgctagggatttgaaggcatgtaaagggctgggtaaagggctgagtaggatatcatttgtagggtgcttcttactttgttgtgtaaaaggaagttgttatattaagattgctttcaagatgtggctaaaaagtaatgtatgtgcttcaggcaggaaaaacaaccaattcctatttctaaccactagcccaggcactttaatttactcctcctaactgcactctggtattagtttatcatcctgattttacaataggagaagctggacttcgcagatagtcagtggcagagctgggttcaacccggggtctggctgacttgaatcctgttcacattcttttctccactctgcctatttgctgtcacatcttggctggcagcaggagagtcaaacctgacagggaccgtgaaaagcctggagttttcagcctgctaggcaagcggcggtgccatagaggtaagtccctgtgagctctgtcatttatttctgtctactttaaatctcttatctgtaaggcgaaaagcatttacgaagctttcaggaaagtgctttgtgattaccagcactagccgagcaatggcttgcctgtttttcacagatagctgcaaaatatgtcttttagggagaattatctgctttcttccacttagattcatatacaaacacaccgatgaagaaatatgttttggattcccatagtgctaggtatgagcagatagttgctttctttttttctttttcttttactttttttttttttttgagatggagtctcgctctgtcacccaggctggagtgcagtggcgcgatcttggctcagtgcaactttcgtctcctgggttcaagcaattcttctatctcagcctcccgagtagctgggattacaggctcctgccaccatgcccagctaatctgtgcatttttagtagagacagggtttcaccacattggccaggctggtcttgaactcctgaccttgtgatcagcccaccttggcctcccaaagtgctgggtttacaggcatgagccactgtgtctggcgagcagatagtttctattccaggttgcactgaatcaggtgaaaaaagcaagtaaacactgaaaaacaaaaaagtaaatattcagttgtaaataaacaaaatccccaaacctaccccggtgacaaatttctgccttatggtaattgttgttaagagtaggaaacccaagatgtaattccattggtatgaaatatcaggtggtccctaccagtgagacaaatattttttaagaccttgagaaaataagaatagaatagaaagaatagaaaaatagaaatagaaaaaatagaaaagaatagaaaggctaatagctctttctaacttaaaaaaaaagtggcactccacattgtgtacatatttcaaaacatcatgccttacatgataaatgatatagtttttatcctcaattgaaataaataaacaaaaacaaaaatgactaaaagcatacctagcccctctttgtagggtctacttggatgatatttttatctttgaagagagaaagaagatgttcgaattggcacctcccttggcctgatgagagcttaatctttagtgtcctttgcgctttgtccatgcatacttcagctatgggagtaattcttaacaaattgtacagttgaccttctataagccagctcctcctgtatgattaaaagattgagtgttgcatgagaatgtgatgattcacgaagccctagacaccttagactccttgctctaatataagttgttgaaacacagacctgagatccttgctgcattctccgggtggaccatgggagccttcagacctggagcccaggccttgctgcagctgctgtgcttatactcctcccgcctaggcttctggaatcagggaattcctgagggaggaaattctgagtcttcaacaaagagccagtttttgtatattcccactgaaaaactgaacataacctttaaagggtaaagaatctcttattctatgattaaaaaagtatattcaaagccaactgattctatttgaaatagctcttccttgcgaggtgcatagttctggctggaaaaaggctttaataagccaggcatggtagggtgactgcttggctctactttgctttgctgttgaaacattaagcgtaatctgatgtgtcaatagagtcacctcagatactcagaatcattttaattcctcttaccgtcaaaacatagtgtcaatactgacacaaattggcattaaaaatatatgcgaaatcacctggagaacaacactttttactgataggagctctctttaaaagcagtttctgtcaaagattcaatttgaactcttttttggctttgaattttacagagcagcctaaaaaaaaaaaaaaaaaaaaaaaaaaaaagccctgacctgctttgcatcattcaaacctatctgtggaggaaagaagcttttcctttgtatctgaccccatgggagatgctgtccattcccaacgttgccctgagacggatgtgcaagatgacacataagtggatgacatcactcatggctcatgattaaatacttccctgggactcacaagatgtgttcagaagaaaatgggaagaaggagtgggtgacactgacaacattcttatacattccacctgggtgcatatttttactactctagatagatttcaggagagaatatgagtgtacaaaatgaaagaatattgatataaaagccttaaattttagttttgagggaatacaaacaaaaatatgcatatatttgccatattatatttcgtatgctttctaatatatagcacaaaatatgtaaatgtatgtgatgtgtaatttgtaaaatatatgcaatttgcaatatatatgttcactgtatatcacatatatgtagtgttctagatccccatgaaaatcaaaaaactaggacaaaattttatttttgataagtgacatattttttgctaagtggcatattcagattacctaagtagtataactacacattcattatttgactttttataaatatattgtaatgttatacttgatttttaaaaaaatatattgtaatgttacatttgaagaggtgaagtgttctttccgcgttatttaggaaattatttatttattaaggtgggaaacccatcaaatgtatgcttattgacattttggcacacacagttgtttgttttattttcttgctttgcaaaaatctttagggaataaatgacctgttgaactgaaaagtgaacatcattgcgtttcaatctttgaaagcaatagattctatcgataggaatgaccagattttctttgttgtttgaaattgttgatctggtcattctttttctagtttgctcatgttagcaggtgtttcatgtgtatttgtgtgtgtgtgtgtgtgtgtgtgtgtgtgtgtgtgtgtgtgtgtctggcagcaaatcactcagctgacctttttcataatcaactacaataaacggagtgtgtgtgtatgtgtgcgtgcctgcacttttggtgtgatggacagtttgcttaaatatatgggaaaagttaatccctctgcccctgacctttggcacaggaaccttgtgcttccagtagaaagtgtggtaaatgccaagtcctttgggcagagaatgtctgcattaatgttttctatgctggagcctgagccatagattttctgtcagccattctttgcactgcggatatggaataggttgagctgtatacagaatatagtgcctgctgccatctgttttgacaccctgaatattttaaccctaggcagtgtattaaaggagaaagtctcccagtccctatcatgcatgtgattgccgtggagtaccgaaggtgaaaggagctgtgcggtttaatgtgattgtcaaagggtcagttgtcatgttaattatcaagagctgagtgattatgacacaaagagggaggaggatggacatggtacataccaaccttgtaaataaagttaactcttgatgttcttggaagcccaaggctgcaactcttcagcatcacacaggcctggatgcagctctgcatatgctgatctctgtctggaatgcctcatcaccatgaaggttttggattacagggaatacgtgtttcaaacagggtaaggcagctttggcagaaagaccttgcagtaggagatgaaatgttgccagtctggcatctgaatttagcagttgagaagccattcttgactcccctacctccacatagcctctattgattcaaaatgtaaacatcccccagatcaattgtttccgctccatctgctttttcatggccttaggtgctctcacatcttgcctagattaattgccagattattggaagctgcctgtccgatccttctgtgtaattttgaaaataatgcaaatctgccatgcctttctgacctgcgtgctattttcacacacaccatgtcttgcccctcctgtcattctacataactctctctctccatgtcctatatttaaatcccacagctacgtatcatctccctggaagcctttacaagtctgatttaaaagtcctcctttggggtgtcatggtaccacgtgcttgttttggttatagttcttctcctgatttattacaatggtctcttgacaactcctgccttccggaacataagctccttgaggtgagagaccgttatattttgtttcgtataccagagctgggcaaagagtagttacaaaataagagtttcttaaattaactaacaaaataacatgaattttagagtagaatagtacatgacagacagtagtcctggtagttggtcagtaaaagagagcattcatttaggagatggttggtgacatacattcattctcataactctcctccctggacctctctcatccctcacctacaccaatcctgacatgatcacttgaaattgacctgggttaaatcatataaatctttgtattccaccttcttgaatcaattataatctttagtgttggttgggagaggaaggcccttcttccttctttctctgatttccaagagggaaatgtcttctaattattcctgggctttttttcttttcttttcttttcttttttttttttgcctcatcccttacaattccccttggagtgagaaagacgactggttagtttgggaattgacttaaggatgcatcgtgtatctctttaccctcctttttctcttggagcgtagctacacacaggagcatgcattctgctctgctaccccatgtcttaaattttacataacaggccctcacacagggaagtctggtgctgccagtgactggatgaggaggacactacttctggtgctcaataacagggatttaaatttgccaaatatacaaaccacattctccaggattagatttatcaatataaaaggtgatattttgctattctaactgtcttactcttttgttttgttgtattttgtatttgtttcagaatgcaggtggagaagagggacgtgtttattgggtgaacttagctcaatgcatagaatttgagagtgaggagaaatcttagctctactccaaatatattaatctttgaaaatttcacttctgcttactaaagaacagtagatcactttatgttacttagagtcagtcatcattggaaacattaattaggcttatgtttgaacaatgaccatggtgggatgagggcagtgacaggaggttaagtgtaagatggaagccagaaggccacagcctctttacatccaggtaagcagcaagattagtactagcagtgagggtttgaaagcagaagcaaggaatgaagatgtctgtgtgtgtgggaaggatacaatgaggataagtatggaaataaagtaggttgtagataccagtaatccaagcaagaaaatataggtcagaaatccagggaagaaacttggataaaaggcatacagaggcatagaacattaagatggtaagatatcctgtatgtcatcaagtctaaacatacattcattatttgtatcatgtcttaaatattgtcactgtactatatcagctctgtgtagtatctacctttttctcagaggcccagccctcactatgtattatcttactttgttcattctgtctttggacctctctaactattctgctttattttgagtcaaatcaatttcttttgattaatctctatgatatttatcactaactgtgatatagctgagccatggaatctcatggctgagagggacataacatgatactttcttctgccatagtacctagaaggatgaatattatcctaagcacagatggcataatttcattgtaaatattgggagtggccttaaaaggaaactggttctggtatctgcctcagaaaatacagctccatattcactaggttaaaatccttgtctttggcagacattcaccaatttgcttggtcaatattaaataacaagtcaagtccttcagtcatcaggggatgactttttcagttaacttatcctggcaggtgccgtggttgtgcattttgtttagagacagctgttttgttggagcataactgagcattttttatggccacagtaggtggctggtaaacctcataagaaagtattttagactcctcctcaactgcacaactccactctcctccaaaaggaagtccatctatctcatggtctgtggtgggtattcttgagactgtatcaagcagtcgttcaaatgcttggcttcaacagtccaaagatgagaaaaattttcacaaaaagcttaaacatatgctctttctatcttctctgagaagtggatggccctttgttctagaggaaatactgattaaatgactaaactttttaaacagggaagatatcaaccacactaccttcttattttccaaagcatgtgcattttttcatcatatccaatatctttaaatgcatttgccttgtctactcaaacaaatgtcagtggcatgcaaaattccagcaatttgtagcctccactctctgatgttcatttctattttctcgtgtaagttttgacaaacttcttctgcttactctcctcctttctatattctgatctttcagaatacagaattcttatctttcttgcctcaggtctcatttttctcgtatccccttttgaacaagtttctgctttagctctttgtctctgagatcattctgctgtttgacttttggttctctgtattggaatcacttataagggacatgcctacttactgtccttgccagagaaaggaatttgacagatagaacctcaatctgttgcagaatctgtttcagaatgccatcactactggcttgagaatacttcatttcttaccagatgccttcttgaaaggcgtgatatataggaatgttgtataaagattatactattgtctactatactactatatatgatttacttttatttctcttatattattagaatactaggtatctatatacttggagtatacacttgtctatatagttatcttgaatgagttatgctttaagattgtgcagtcagtttttttcgaggttcactagaagaaacagcctatattgaacttgttttgttaacagattattgaggatattgtccaccatatcatacactatgttatacataaaccttcggaaacatgccttttagtatttaacaggggaaaatgctatctcttcccacatatgctttctccttttaataataataaatttacattgccaacaatgtaactcattacgttcccatttattttgctccagttgccaggaagctcagaacaaaatgtaatggttaaatgtagcatttgatattctagttagtacaaatgcattttccctttatctgggttttatatttatatcttattaggttttttttttgtctgtgtgctcattgtcttagtctgttttgtgttgctgtaacagaatatttgagactgggtaatttataaagaaaagaggtttatttagctcatggttatgcaggatgaaaagttcaagggcatggccctggcttctggtgagttcttctgtgctgtgtcataacaaggtagagaaggtcaaaggggaagtgaaaacatacaaagagagagaacccgaggagcatcctggctttataacaacccattcacaagggaaaaaatccattccctaaagagctaatccagtcttgctacagcaagaactcactcattgtcaggagaatggcaccaagctattcataagagatgtacccccatgtcccaaacacctcccaacgggccccacctcccaataccacccttctgaggatcaaattccaaaatgagttttggtagagacaaaaccaaaacaaaacaaaacaaaataaaaaaaccatatccaaaccatagtaccaataatctcaaatttactttttagagtcaggatactatattgacttataatactttccctgaacaatcctcttttttgcttgggaaagatgtgataaagtccttagagacctactcttagagtctcagagcatccttgaaatatttcataatataagtctcattctaactctttgagtacttacaatgtacgtggcatgccactagatgctataagtcatgcacaaaccaaaacaaacaaaacatagcccctttcctcagttctgctgctttattgctggggcacaatcttctacaaagtagtaggtttttaaggacaattgagaagttgaaacaaactataggaggctaggaaacgtacaaattgagtaatgagggaaggctttgtggagaagatttcgcttgatctgggattcaaactgtgtatagatttgagtacatgaagcacacaaatgagtgtaatggcgtactggtaaactggtttccccttccacttcagcaaagccctgctttgcagtgtttgccagtttccatggtgtaaatacttctgctatggccaatttgaagctatcagtaatttaaccacatgcttgcaaagttcctgaatatttaaaaattagctgtcatgagcctgtttgagctgggtttagcataccactggatgaagtctttatacgaatgtgatactatgagtaagagttcagatttgtgaggtcccactaaggaacagaaaacagtcctgactgtctgcatctggaggttcatattgggaaatgatggcaagatgtaagagttaatttgggacagaatttggaggtttttgctgtgcacttggggtttattctttaggatgtgggaaggtcttgagtacttttaatagaggaatgacaggatagaattaatgttttaggaagataggccttttattatttatatgctgagtggttttaagggaatagagggcagcagaggtgagacctaggagcttcttgaaatgaagtatgtatgaagtaataagggaccagagttaggacagaagtggccagcatgggaagggaagacaggtgaaagggaggacagtggggacagtgcatctctggtagtatcgcatcagctgaattggcttacaagctctgactggaatcaactgagggttaacttacatgtttggggattgatattggatgttactagaaccttcagtgaggctgtggagagaacacttatgcagattctttacatgtggctgcttggttttattaccgtatgctggctggattctaaaagtaagagtccaagagagatagacagatgaaaagcacattgccttgtacaacctggccttgagaatcatatgatgtctttttcactacattctatttgttgaatcaatcacaaaagcacagctagttttaagggaatggaaaatgagacctccacctcttgatgggagatagcaaggctataaaagaccatgtaagagtgacacacaggagtttttcaataagtgcttgctattattatcattatatgagtttaagtgtctccaagtaaactagttccctctgaaatacagtgaatatttttagtaactgcctggtatgttttctgtgtgttcagtaacaaccttgaaaaggtggttgtgtagctctcattaagtgaatgatataattactatttggttctattacacaagactacagacaattttcttctctaagaagggggaacaagatcttacgtgtatgatgaggttgcttttatattaattaacttggacaaagtaacataataattgcaaactcttattgacagcttctcatgtactaaactcagtaaattatttttatccatgatcttgtttaatcctcacaaataaacctgaagagagtattattagccccatttatgaaggataaaattgaagttcagagaagtgatgtaatttgcctaaggtgacattgttaattaatgaaacctgaattcagttctagaactgtgttcttcctccccttcacgagatgtattgtatcacctcttcatgagctagaatgtatcacctcttcatgaggtgatatggtttggctgtgtccccaaccaaatctcaacttgaattgtatctcccagaattccaacgtgttgtgggagggacccagtgggaggtaattgaatcatgggggctggtctttcccatgatattcttgtgacggagagtaagtctcatgagatctgatgggtttatcaaggtttcaactgttgctccttcctcattctctcttgcagcttccatgcaagaagtgccttttgccctctgccatgattgtgagacctccccagccatgtggaactctaagtcaaattaaacctccttttcttcacagtcttaggtgtgtctttagcagcagtgtgaaaatgaactaatatagtaaattggtaccagtagagtggggcactgctgaaaagttacccaaaaatgtggacatgactttggaactgggtaacaggcagaggttggaacagttgtgaagggcttagaaaaagacaggaaaatgtgggaaagtttggaactccctggagaattgttgaatggctttgcccaaaatgctgatagcaatatggacaataaagtccaggctgaggcggtctcagatggaaaagaactagttgggaactggagtaaaggcgacttttgctatgttttagcaaagagactggcgacattttgcccctgctctagagatttgtggaactttaaagttgagagagatgatttagggtatctggtggaagaaatttgtaagcagctcagcattcaagaggtgacttgcatgctgttaaaggcattccattttataagggaagcagagcataaaagtttggaaaatttgcaacctgtcaatgcgatgaaaaagaacatcctattttctgaggagaaatttaagtcagctgcagaaatttgcgtaagtaacgggaagccgaatatattcccaagacaatggggaaaatgtctctagggcatgtcagaagtcttcatggcagcccctctcatcacaggcctggaggcaaaaatggtttcacgggcccagcacagggtcctggtgttgtgtgcagtctagggagttggtgtcctgtgtcccagctgctatagccatgactacaagggggcaaggtacagcttaggctgtggcttcagagggtgcaagccccaagccttggcagcttccgtgtggtgttgagcctgtgggtgcacagaagtcaagaattgaggtttgggaacctttgcctaaatttcagaagatgtatggaaatgcctggatgtccaggcagaagtttgctgcaggggcaaggctctcatggagaacctctgctagggaaggtggaagggaaatgtgaggtcagagcccctgcacagagtccctactggtgcaccacttagtggagatgtgagaagaggaccactgtctttcataccccagaatggtagatccaccgacagcttgcactgtgtgcctggaaaagccacagacactcaatgccagtctgtgacagcagctgggagacaaggctgtaccctgcaaagtcacaggcgcagagcagcccaagaccattggaacccacctcttgcatcagagtgacctgaatgtgagacatggagtcaaaggagatcattttggagctttaagatttggctgccctgctagatttcagacttgcatagggactgttggcccctttgttttggccaatttctcccatttggaatggctgtatttacccaatgcctataccccaattgtatccaggaagtaactaacttgcttttgattttacatgctcataggcagaagggacttgccttgtctcagatgagactttggacagtggacttttgaattaatgctgaaatgagttcaaactttgggagtctgttgggaaggcatttttgttttgaaatgtgaggacatgaaatttgagagggaccaggggtggaatgatatggtttggctgtgtccccactcaaatttcaacttgaattgtatctcccagaattcccacatgttgctgaagggacccagtgggaagtagatgaatcatgggggctggtctttcctatgctattcttgtgatagtgagtaagtctcatgagatctaatgggtttatcaggggtttccacttttgctcctttctcattctgtcttgcagctgccatgtaagaagtgcctttagccttctgttatgattgtgagacctccccagccatgtggaattataagtcaaattcactctcatttttttctcagtctggggtatgtctttatctgcagcatgaaaatggacgaatacatgaagtatacagtatcacttctccatgaagtaaggaactggaatagaaatagggccttaatattggctgcaaagaaataagtgtctaagagtgggattgctaatgttgcacatgaaatgataccaactatgtggaggtggacagggattcagaaagtgatggatttaggcaagtacgctgcaaggtttcaagtaagaatatagaatggagtcatgccagaaaaccgtgaaaacatgcttgtagaagagcatagccatcttcacatatctgttttagcactaacaatattagacactaaaactctactaatatatctgcttctcccagtggtctctgtgctcttggcaaagtgtagtatgtagtagattttcaatatatatctataaaactaaagagaaaggatttgcacttcatccctctttgactctaagtttatttccattttgttttccaaatgtaaagtttcttcaaattttaacatctattaatgtttctaattggaaccaaaatatgggatctctagagctcttctttgcttcttagtccagtgcataaaggtgaaagaagcacattcttatatacctgtttccgggttgtaataatcctgatgggaaaaggaagatgaaccacagggcaatggaagcaatactctgttatagtccctagagagagtcataatccttgcctataatgctgtatagatatccttctgcaatatcagtttggaaagaagaattcagtaattcatcagaacagttagaaaactgctagaaactttacgacctcatattctttaaagtaaccagtttattgtatcgttgtgacttttatttgttctcccccttgacatttatgtgatgagcacctctggtgatggctgaaattacacatagactaagaggactcaggcataacaaagatgtcttttaattttcctggagattaatctctccatcttaaatctacaaaagtaaactttttattggtttgattttgcaccccaatattttttccaagctacaattagagatgaaaattaagatagcaatgaaaaaaaactctgatttattacttttgacaggggaagtatttttcccaggctgtttctgaattcctttctttagaggaaatagcaggggaaggtgactatttctcagctagtagcagcttccaaaagaagaattatatttgggaaaatatttgagattaaatcacattagaaaagatgcatctcatcaaatcaaggtattattcaaataaacccatatcctgttttaaatgttaagtctgtatgttttaaagcttagagttttaacagtttatgctccttatagatagatgacataacctctacaaaccagaatttcacctaaagatggcaccctcctttggaaaaacacaggggctggtattttaatgagcatttgcaagccaagtgcctgatgaactacgtgtttgtgctgctttttaaatcgtcacaagtcgttgaggaggtattgttatacctattttgcagaggaaaaaactaaggctgaaattcactaccttgtctagggagctgtaaaacataaatagaagagccaaaatgggatgcagattatcctaaaccaatgcctctcaaactttttctttcttttttttttgaaactcaagagagtgcaatggccacgggcccacttttctttccctgcctagttgtgaaatgttgcttgttatttctaccaacctaaaatattattcctggcttttttctttctgaatttttaaatcagaaagccaatgggtttctaaaataattttcaatattgaaaaatatattttaccgatattttattgatctgtgatgccattgattgaaagacataccatgggattatgtatgttctactaagaaaaacaaatgctatcaacaaaactatgacataatgccttataaaacagtcctgcatgatgcatgaatgagtcacatcaccactcattgtctttcatcaattctaagaaatttagcaatttcttttgtttttaattcctctgcatggcaggtgataggcaatcccttttgtatgcatttaataacaaaacctaacacagcttcatctacttctgggtatttttttcttaggttctgtaaaacacattgttgttttgtgaggaaataaggggctctagtcatccctaaaatgatgaatatttgcctcactaaaaggaaacacattccccactgctctatttctgtatatttttgtgtatataatgacttctgcctcaatgccgaatcatgttgcaatcttttagaagacactttaaatggcaattaaactcaacacttgtagcaccaagaatattcaaaactcaatggaagtgacgacaatgtgaatatttatactgaaagcaatgtcatccacatcaaaactgccacctggccagcagtgattataatatgccattaaatctaagactcttcctaatttcagaggtattaaaatgtgaaaaactatacttcttagaatcaatgaaataagtaaatattaaatatgctttttgatggcctctcttttctacatttcagattctgatcgggtcccagctcttctattctcgaagcacccctgtcccctatacctctcatcctgcagagaaatactgctgtacgctgtgcctctttccagcaagaaaggtttcttcatctactctaggctgcattttagcatttaccccaaggcctgttacaaatggacagaaaattaaatttttctttttcctcttaggaagagaaaacctaactatatttccaacttataacagtgtattttccacgttttcattgtatcatggtcatgtgtagccctttgctgatagacagggtgagtgtaaagggatttaattttcactgcttgattgaactcgtcactaaactttttaaacaacttgatagtttgtatataagaattattttctgtaagttgtctgtttactctgttgatagtttattttgctgtgtagaggctctaaagtttaattagatcccacttaacaatttttgctttttttgtgattgcatttgatatcttcatcatgaaatctttgccctttcctatgtccagaatcatcttgtctaggttgtcttccaggatttttatagatttgtgttttacatataagtttttaaaccatcttgagttgatttttgtttatggggtaaggaagggacctagcttcagttttctgcatatggctagccagttatcccagcaccatttattatacagggagttttccccattgcttgctcttgttagctttgtcaaagattaggtggtcataggtgtgcagccttatttatgagctctgtattctgttccattgggtggtccatttttctgtttttgtgccagtaccatgctgttttgtttactgtagccctatagtatagtttgaagttgggtaacatgatgcctacagctttgtactctttgcttagtattgccttggctattcaggttctttattgattcaataggaattttaaaatagtttttttctagttctgtgaagaatgtcattggtagtttgataggaatagcattgaatctgtaaattgctttgggcagtatgaccctctcaatgatatgaattcttcctatccatgggcatgggatgttttttgaattgtttgtgtcttctctgatttctttgaaaagtgttttgcaattctcattgtagagatctttcacctccctggttagctgtattcctaggtattttattctttttttttggcaaatgtgaatgagattgcttttctagtttggcttttggcttggctgttgttggtgcatgggaatgctagtactttttgtacattgattctgtatccaagtatttgcaaaccatgcatccgacaaagatctaatatccagcatctataatgaacttaaacaaattaacaagaaaacaacaactccattaaaaagtgggcaaagggcatgaacagatacttcaaaagaagacatatatgcagtcaacaagcatatgaaagaaagctcaatatcactgatcattagagaactgtaaataaaaaccacagtgagaaagcatctcacacctagtcagaatggccattattaaaaagtcaaaaaataacaaatgctggcgatattgcagaggaaatggaacacttacacactgttggtgtgagtgtaatttagttcaacaactgcagaaagcagtatggcgattcttcaaagagttagaagcagaactaccattctatccagcaatcccattactggacatatacccagagcaatatagatcattttactgtaaagacatacgtacgtgaatgctcattacggcagtagtcacaatagcaaagacatagcatcaacataaatgcccaacaatgacagattggataaagcaaatgtgatacatgtacaccatggaatactatgcagccatgaaaagaatgagatcatgtcttttgcaggaacatggatggagctggagcatggataataactgaggaaaggaaaaccaaagaccacatgttctcacttgcaagtgggagctaaatgataagaacgtacgaacacaaagaaagaaacaacagacactggggtctacttgagggtggagggtgggaggagggagaggagcacaaaaggtaactattggatatgggcttaattcctgggtgataaaataatctgtacaacaaatccccgtgacatgagtttactgatgtaacaaaccttcacatgtacttctgaacctaaaataaaagttacaaaagaattattttctattattaaacatgtcctttggaaacattttcatatataactttgaatactttgttgtgccctgaggaaagtatgcagtagctgatttttgacttttattgaaaatgttttttgttctccattcttcacaatttttccattgaaatgtaatgataatacctgcatcgtctaccaatccaaacaatatatagtcaaaagcgaaattgatagtctctcactttctctttctaatcccattttctaatgtaactactgtaaactatgatttcctttgctgatagaaacaaatgccacacacacatgcgcacatatatacatatatacccattgaagattaaaaaacaaacaaacatgaggacctaacatggagctgctattcttccctaatggtctgttgcggacctattttgaagtcgatgcataatgatccacatttttaaatagctgcttattgtttcatagaattaatatatcatggtttaggaaaccatttccctatatatggatatctaagtctattccagctgcagtaacaaaatgtcataaactgggtatcttataaataacagaaatttatttctcacagttatgggtctgggagttccaagattaaggtatcaccagatttgatgtctggtgagggcttgttcctcatagacagtgtcttcttgctgtatcctcacatggcagaaagggcagacaaactcctttgggcctcttttgtaagggcacaaatccctttcattctctaaaggcctcatctcttgctactattgcactgaggattaggattcaacatataaattttgagggaacacaaatatgcagactatagcagtggatagtccagttatttacagatatttttattataaatcttttagatatctttttgggtaagactgttgacagtatcagacattgctgatttttcttttttctttccccctgatggaatcctaaaaatgaagatactcagtgagggagtgtgcgtactataaattttatattgctagctttattttccaaaatattataaaaatgtacattcatcaataataaatgagactgcctttttctgtaggttttcattagcactgaatgttctcagacttttacatggtcacgtaataggcaaaaaaacattgtgttgttttaatttgcaattttatgtttactgatcatggtatattttcattttttattgatcatttgcatttcctcttttgtaaactgccagctcttatctttgactcagtttagactgtctttttctaattggtgtgaaagaactctttattagaaataataaacaatgagtgcttactctttaacctgactctgactctcagtactttataagaatgaatacgtttaattaatcctcacaacagccttatgaggtagatacaattttataggtaaggaaactaaggcagagaaaggttaaataatatgcccaagatcataccgctagtaagtggcagagctggtgttcaacctgaggctgtcgggatgtaaactcatgtcctaacccctgcgctatgttccgatcagctggaagggaagatttggcgtgtgtactgagaacaaagagatataccatcactgggtgcagaggagccatggcaggcatatttcagagcatattggaagacaaatatttatgtctaaagtctgataagaatgatacttctcttaagaaaaaatacaaaacttaccatttcgaagtgaattcttgacaccgtagattgttgttgaaagtgaactgtgggggacgttgggaaagccgatgaggcagaaactgaacagtgaaagcaaaggagcagagaggaaaaccttagttgcacgatgcattggaggtcataaattctttaacgcagggagactgcaaaaataatgtcactactaccttctttgttatttgtagtttaagtaaattgtatgtagttttcattcctttagctactctgaattaatccctttgtggtctttataaagttctccgttaaagaaaactggcatctgggccttccttttccccgaggattgctacagaacagatagatttataactcttatgatatttattttaaaaactttggatgttccagaagcacaacttatatttttctcaatacctctgtttagtttcaattttggaaccctgagtttgcctgattgcaaaaattaaaaataaaatatcttagtcaacttaagataaactcaggcgtctgttttaagctcatttaattctcttagttattctttcctttttccaataattttctaggagctttggaccatgggagttgggaaggtgatctggctcagggccatttttcttacaagtgagtatccacaagatgatacaatcctttctggtctttggacatgaccatacttctcatggaatcttatggggcatctgttttgaattgaattgtcttcctcaaaaatatgtattgaagtttatcaattatatattgacgataaatatgaaagtacccccccatatctcagaatgtgaccttatttggaaacagggtctttgcagatgtaattagttaagatgaggtcatactggagcgtgatgggcctctagacaataagaacagtatcttcttataagaagacaatatatgaacgtacgagaggagaaggccatgctctgagagaagcagaggttagagttatgcatctgtaagcccaggagtgccaaggattgctggtgacatcagaagccaagagaaaagcatggaacagattatctcccagagcctttgaaagaacctggccctgctgacatctggattttggacttagagctctcttatgggtgtgggcacagggcaggctctacacaagtcccacagcctccagaacagtgaaataataaatttctgttgtattaagccatgaagattgtagtaccttgttatagcagccctaggaaactaatacagcatccaaactcaagccacttctagagtgtcctcttagcctagagttccaggcatccactccattctggatcacttgggaaaatggccatttccagtgtcctgtcaaactgcccatctgctagagcacttaaaaactctgctttactcaggggccagggtagcttggatactgcctgtagtgcttgccagcttccaggacaacaagacagagacaaggcttcagtactttctgttcttcgatcctgaaacccttctgggggtcctatactcttatgacttagagctctcttatgggtgtgggcacagggcagtctctacacgagtcccatagcagtatgttttcctgctgctctttttgctaaaccttccccttctttacctatcacacctctcatatccatatcctctcaaacttgggatttttgtgggatttttatctagactaggtaaacagaaaacaactgcttccacagcctggtctatatgtatttatccctgaattttttatttggcatctggcaggtatgaaagtctagaatttgctatctttattcttgggttccttcatgacaagaatgggagagagtcgctgtggaaaggaatagtacaggaaaaactcatttactaatattttacaagagaattctgacgaaagtagccaaggtggatgcacaagtcttagctgaaaattgaggtcaaattctaaagcttagaacagatgcgggtacccaaactgcatctcttacagaatgtgaccctttaaggagtatacctatccatgtacagtcatatttaatgaagtcgaagggtggcagtatatgccagtcattgtgactaccgcttgatgcctaaatatcagtctgtcagtctgcacattaatattggctaatgttttcatgaatttgttttcttgtcagaaaatgtgagtttcttcctagcgtttttgagggcttttgtgcatttgttaagttgttctggaatctttctgctgtgacgtggctgttttttgttttgttttgttttgttttgacttgcctattcctgattatattttacctttgtatgattggggaatcatgtaggacctgatataaataatcaagtattttaatagagtgatacattctgaatagagctgatcttgacataaaactaagtattctaataatacggccgggtgtggtggctcacgcctgtaatcccagcactttgggaggctgaggtgggagaattgcttgagctcaggaatttgagaccagtctggacaatgtagcaagaccctgtctgtacaaaaaaatttttttttaaacccactaagtattttaatgatagaggaattattatatacctgctatatccttaacacaaaagtgtgtggtatggacgggggtatgagaaatttgtaaggcatgatataaatccacatggagcattgcatctactagagtagcaggacacatacatccatgacacacaaaaccacgaatacatacaagttacagaatgcagattattatataattaaacagtatataacatactgcctactaagcagcactcaggggtgaggtaacaactcgatcaggatgaaataaaactggcctggaattacctccagctgaagatgacttgattcttgaatctggccggattctgtctagagagagaatactcctgggccagctatgcactgttctccaaacttggaaaagtggcaataagtaggaaagaaatcccattttaagggcacatgcacaacaggaagccctttttttctagatagactcctggatgcaaattccccaggtttatattcacttaggcctcaatctcactcaggttaatatattatttgaagtgattttgctaaggatagacacacaggtcttactacatgcgggctaaatagttgaagatgtctctattttctgctaccctagtgctctctctttgtgcagccgcattactcaaacaaacaaaagaaaatcttcccagaacactaggaagccacacctttggtatcagtcttgtatggaagggtagaaacatgtgggcaacttgagacctgaggtcaccatccaaactcatcaaagaaaatagcaccagtgcacagtcagttatcttttagaatggtttctgccaatcattctaatctattttgtattgcatttttaattttattcattgctatatcacttaattcccatattttatgttgcctttgtgactattttctcttgtgtgaaagtacctcttagtcattcgcttgtcgtagttgtttggatagttgcttcaattttttatttctatttatttatttatttttgctaatggattatcagcatttaattatgatctttttgcttttcttgatttttccctcattatgaagttcctggagtgagattactgagttaaaatgaaagaagttgtgctgttttccagaatggctgtaacaatttacaatgctgtttgccatgtatgagtgtgttagtgtggcagattccatattctaatgatggccataagaatatcttcattctacgtgatctttgcttatgtgaccttgacattcctctcatcaagcggtgaggctctccccacaacacttgactctgggtgggcttgtaacttgcttgtaaccaatagaatgcaaccaaagtgatgtggcatgactgatgaggctgaataaggaaaagcaatgcagcctccaccttgttttccagaacattcacgttcggtgccatgaactgccatataagaaatttgggtgtcctaagaccacaataccagaatgcatgtaccaagccacatggaaaggccacatataataagcaccctaaaagtagttctagatttccagtctcccaactcaggtgccagggtttggaagtcctattgacatcccagcatgaaaatttacttggcaattatgtatatggacttgcctctcaggaagaggctaaagtggaggtctggatttaaaggtcatcaagcaatgatgaaaattgaaactatgggagtgattgtgattgcctaacgagagtgtatcagttaaccattgccacatcacaagccatctcaaaacttagtggtttaaaacaacactaataaatatttattcataattctgaaacctgagttgggctcagtggggtagcttgtccctgttccacatggtattggctgaggtcgttcatgcatttgcagtcagttgatggcacaactggagccggaggatgcaatgtggccttatccacatgtctgtcacctgagataggattgttggaatggatgggagccggtcagatctttctcttccccatggtctctcatcttccagggtctgtctctatacataggcctgtatcttcaagaaggataccccaaactttcttacatggcatctctgggtggcaaaaaggtgaaagcagatgtcttaaagcccagctcagaatttgtatagtgtcatttcccttcattctattggttcaagcaaaaggccagcccagtgagtgtgggaggggaattgaatgtgaattcagtgattcactaaggctgttatctaaccatcagtcaaaaaggatatgggaatgagaataatctaatgcttggaagagcacgacatctaaagagtgagtgtagaaaaagaagcccattgtgtgatattccccttcctgtgtccatgtgatctcattgttcaattcccacctatgagtgagaatatgcggtgtttggttttttgctcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtatgcatgtgtctttatagcagcaagatttatagtcctttgggtatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgttgtttcctgactttgtaatgatcgccattctaactggtttgagatggtatctcattgtggttttgatttgcatttctctgatggccagtgatgatgagcattttttcatgtgtttttcggctgcataaatgtcttcttttgagaagtgtctgttcacgtccttcgcccactttttgatggggttgtttgtttttttcttgtaaatttgtttgagttcattgtagattctggatattaggcctttgtcagatgagtaggttgcgaaaattttctcccattttgtaggttgcctgttcactctgatggtagtttcttttgctgtgcagaagctctttagttttattagatcccatttgtcaattttggcttttgttgccattgcttttggtgttttagacatgaagtctttgcctatgcctatgtcctgaatggtgatgcctaggttttcttctagggtttttatggttttaggtctaacatgtaagtctttaatccatcttgaattgatttttgtataaggtgtaaggaagggatccagtttgagctttctacatatggctagccagttttcccagcaccatttattaaatagggaatcctttccccattgcttgtttttctcaggtttgtcaaagatcagatagttgtagatatgcggtgttatttctgagggctctgttctgttccattgagctatatctctgtttttgtaccagtaccatgctgttttggttactgtagctttgtagtatagtttgaagtcaggtagtgagatgcctccagctttgttcttttggcttaggattgccttggcgatgcgagctcttttttggttccatatgaactttagactgtggtggggtggggggaggggggagggatagcattgggagatatacttaatgctagatgacgagttagtgggtgcagcgcaccagcatggcacatgtatacatatgtaactaacctgcacaatgtgcacatgtaccctaaaacttaaagtataataaaaaaaaaattaaaaaataaagaataaaattctaggtcattcagaaaactaaatggaaaaaaaaagaagaaaaaaaagaaaaagaagcccattatgtgactgaagggtgaccagagatacaggaggaaaagcaagtaagaatgatattatagcaattaaaaattccacttctagaaaaatagaacggtttgttactgccaaagtaagaacataataatgaaacacaccttcagatttaataacaagcagttattggtgacttcgacaggaagagattcagtggagcagaaggagctgaagccagattgcagaaggttgaaggaaggaagcacagggagagagaaggttgcctgtaaaagggcagagagaactggggaaatagccagaatttgacatgtttctattttagtttgttagtttgtatatacaggaggaatttggaccagtcaaaatgctgagaggaaggtggagacaaaaagggaaaggttgaaggtatttgagaaacaaatattaaggaaatgagttctagtttctagttctagtttagcagaaattaaaatcagtttaactgtgcagaacaagattttgttaccttaagctattattttcattcattttaattttctaaaaagacaatttacttggaatcaaaaggagtaaaatccattaaaatgtataaatatgtaatttcactttgctttttgaagtgcccagttaagaatgatttaatctaaaatgaatccatttaaaagtaaaaatgtttaaagtaagaggaaatattttgaaagtatattgtcttatgaaagtaaatagtatatttaaaatatgcatccttgcatttgacatatttattcattttcttcaagatgtaaatgctttaacaaatgttgcaaatgtagagaaataaattaactttacatcaaagagcaaacatctcacaaatggcaacaagagagcagttgtatttaagatgtctgatattcctttatgtctatattaataataaataaaatatttcactgtactatttttcctcatggaaaaccctgctgtccttattcatatacaaatcaagctgaagggggatctggatgcctgtgtacctcccagaagctttttctggaactgatttgatgagatgatttacactttctaaccatccttttatacagataggctcttcactatttttacctttggagtcctgggtattttgctgggtttgataaagtggatcagacacacatgtttgctccagagagtttaaacatacattattgattctatcgtttgaaggtaaaaatgctttcagaagaaacttggaaaacaagtctaaatcaattgaatttaaagaccaatagaaatccctagatatggtttccacagcaacaatttgaatgtttaatatttctttgcactcaaaaggtaattaattgcttcattaattcaatgcaaaaattttgcaacctactatgtgctaggtaactgagaagcaaaaagaataaagccaaatggcatcttgtttttgccccttctctcccatccggtagccaatagagagttcacagtctactcaggatgccaggcaaataaagagttttaataataatgtgatatgtgccataatgaaggtgggaaaaatgtactttgaaagcacagaaagaagttaaatttgtctgttgagactaaagacagacaggaaagactcacctgtttaaacagctgaggagacatttgagttttattttcaagaatgatactggtttgtagaatgaattgagggcttgggaagaggtgggaggatggactgagtggtcaggaggaaagaagtgcatcctgttcagaggaaatagcatgtgtaaagacaaagaactgttaggacattgtggttttggagtgctccttgcggttttttttctctagtatgacagaaggcatgatatgctgagggagtgaaaagttattatgctggtagagtagacagagatatgataaaacatttctgtgacatcataagaagtttgaactttattagtggggaatgttgaatgatcaattatttatatcaggcataaatattaagaacaggaaaatcagagcaatgaatcataggacttgtatgacaagaggtgattaatatttctatttctctgccttcaagaaaagcaattgtcaaggtatgtttgcgggtgacttgttcttttatgtaaaagagtctgggggatgcccccttgttacttgttgtgttattgaatagtttttatcaacaagacttaattccacacgctgaatctcacagtgtgtaattaaatcttagactcttgttttatccttagggacatgaagacctcttttggcaatttttaattcacttgaaggcaattttaaagttactcctttgacttttcattttggactaaataatcctatctcatttttttcataacttctatgttacaatgctttaaaccatttcagttgctattttctggatttttctcctagtttcttgatatattccttgtaagtggtaaaataagcaccaagcaatataatattttaaaaagattctgggtgatgttagatctaagataaaggattattcccagccatttcttatcatacatctgttaggatatacctagtattatgttagaattttttaaaggcagctctgcattggtgaaagatacaatttatgttttgaccattcttttttcttttctattttgcagttaaaaacattttaaaagcagtcttgtaaagttttttcttatcattgatgggtgatttctcttgacatcttaaattccattcatatctcaagcaacaagctataatgaaatgaggagatgtttgggagacccgagttcaaaccatgtctctttaagaaaggttggaatagagcaatttaagctaaaaaagtcccagaataattatgggacattctcaaaagtatcctaatttggatgataacctgcattatcactttaggctcttgtaattatgagtttatgcttctctgaatctcagcttcctccttggtaagagggaacaaaatatatagccaatacaattgctgggagatttaaatattttaaaaagttaaaatttttagcatgaagcttgacacaaagcaaagactttagttaaataggccttttcctcttttcttgtcccctttttataaaaatgataattcctcccttcaaatcaggtagtctctgtatacataaattagctaaatatctgagataaaaatatacccaacgaaataacatgtttgtaaagttcagacttagatttcagtaggaagcttaaggtgcatccttgctatacccacaatctaggtcattgctaatgacattgcataatacagaaatctatgtacaatggcttcagttatcccttagcttcatatgcaaccaataagaatgcttctatgttcagctgagccttcagtttttagatgaaatctcattaaaacagaatttcaccaagtgcattcttaggaacactgttccctgtaagtagttagtggacattatgaatggggaagaagtgctgcggacaaaaacaaacaaacaaacaaacaaacaaaacaaaacaatgtggaaatgggaaatgttggaataaacaaagttaaagttacctgtaacttgcaggatttcccagagcctttagcatactcatctttactgtgaatctgaaagagtgtaatatagtatgcagcatttacaaaataagtaattgaacttggatccctttttccatggagctcctcaacataccaagttattgagagctcagtttaccacagtgttttccagtcttggtagaatgttcattcatttatttaaaaaaatattgttggcttacagcatttattgattgagtgctttgtgtctaagtggcacttggcacttcaaaccatattatttaacacattataatttaatatgtaaaaagtaattagaacttaaaaagtatagtaacatggtaaatttggtaaatgattttttcattcttattttgtggcaaggatttagtatgttagctgtttagtacaatggtttccaaactttctaaattgtgtcctcagttcttcacagggcaaatatacttatttatttataaattgtatttgcatattaatgggttaatatataatgtaagcatgtgcaaaatttagatgttcgaagggattagatgaaaaaataaatagaaatagaaattctaatattttcttcctgggctttgatggttcaccttgccaacctctaggccacatacttctctctttggagaccattgtactagtagtaaagaagcaaagaaggaaacagagataactgctatatacttggaggaaatattgtctttcattcatcatatttgtcatcacttattatggagaaaattgaggtttgacactattgtaaactgttcacaaaaaaggataaagaaataattttttgatcttaataagcttatcctgattgaaggaaatatataataacagagaaatattgactgaagaagacactcattgaaaatggtgcgataggagtctccagtgcttgctcattcacagaaacatcaattttaataaccattcatgcacaaatacctttgcaagagctaaggaatcaaagtgagaattacagtacctgggtggaacacagaaataagaaaaggcactttgaagaaggtagaaaggattgttgcatattgcttgcatcacttctctcccaagcccacacagcacagtatatatatattttatatataatatatatatattttatatataatatatatatattttatatataatatatatattttatatataatatatatatattttatatataatatatattttatatatatacatatatattatatatatattttatatatataatatatatatatatatagagagagagagagagagagagagagagagagataatcttcaggttgggaaaacagttacataagcacaagacttcatcataggctacagcaccaggtcagccccagtgaacctcagcaccagacttgcccccacagacccaggttttaggcttgtcccagtgctaagctggctctcaaagcctcagtcttcaggcctgcccctatggactcatgctgtatgatagctaccatggctccaggcactggaccagtacccatggacctaggcttcaggctggctcctgcaaatctaagcgccagccctgccccagtgccagaccaggctctgtcatcccagattccaggccaaatgtcacaaacccaggtgccacacctgtctgccctctgactgaagcatcaagccagctgttctggtgacttcagtagccagcctgtctatggaacctcagagcggagctgcccagaatttctggttgagccaactggtgaagtgtttttccttttaaagccagtctgtaaagactagaaacagtgcctatttctttaactgcatagacaccaacacaaggccaaaacgatcatgaataatcagggaaacatgacaccaccaaaggcacaaaataaattgccagtaactgaccctaaataaatagaagtatatgaactgctagataaagaattcaaaatgattatcttggagaagctcagtgaactacaagagaacacagataggcaactaaacaaaaatcagattaaaaatatatgaacaaaatgggaagttcaatagaaaaatagaaaccatagaaaagaaccaaacagaaatactagggttgaagaacacataattgaactgcaaatttctacagagagcctaaacagcagacttgatcaagcagaagaaagaattggtgagcttaaagataggtcatttgagaatatctagtcagaggaacaattttaaaacaagaaagacaatgggactatggggcaccattaagcaaacatatacattatgaaattttcagaaggagaagacaaggatgaaagagaggaaagcttatttaaggaaataatgatagaaaactttccaaagctggagaggaaaatgaacatccagatccatgaagcccaaaagtaaacatggaacataaacgtatatttagattagacgtaaaaagatattcacttaaacacattataatcaaattattaaattaaagacagaatctctattttttacaaggcagaatagtttctattgtgtgtgtacacacacatatatatatatatatatatataccacattttctttatttgttgatgggcatttacattgattccataacttgacagttgtgaatactgctgtaatatgagatatctgcaatctgagagtgcagatacttctttgacatactgatttcagatcctttggaaatcccagaagtgggattgctggatcatatggtaattctatttttagtttttgagaagccttcatacagttttccataatggctgtactaatttacatttccaccaacaatatacaagggattcctttttctgcctatctttgcaaacactggttatctttcatctcttttataatagtcgttctacaaggtatgcagtgatatctaattctgattttaatttgcactactctaatgattagtgatgttgaacatattttcatatatctgttggccatttgtatgtatgtttgcagcaacatggataaacctggagggcattcatctaagtgaaacaagctgggcacagaaaaacaaataccatatattctcacttctatatgaaatctaaaacaaccagactaatggaagaagcagaattgtggttttcagaggccgaggaagggggactggggagatattggtcaaaaggcataatgtttcagttagacagtatgaataaatgataaatatttaaggtgttgaatatgttaattaacttgatttaatcattccacattccatacatatatcatagcatcacattggagcccataaatacctacaattgtaatttatcaatattcaataaaataaaaaaagaagtcaaagagaattttgaaagcagcaagagaaaagccttttatcacatacaagggaaactaccttcccttataagactatcagcagactttttttttgcagaaacctcgcagaccaagggggagtgggacataatatacacagtgttggaaagaaaacaacaaaaaacctttcaatcaagaatattatacgtggcaaagttatccttcagaaatgtgggaattataaagatcttcccagacaaacgaaagctaagggagttcatcgtcactagatgagccttacaagaaacggtaaagggagttccttcaattgaaaaacagtacactagctaagaacataaaaacatatgaaagtatagaaatcactgtaaaggtaagaatatcatcaaagggtcagactctagtactatcaatagtactagggtcagaagaccctagtactattatggtggcatataaattacctttaacactagcataagagttaagatacaaaattatcaaaaataactttagccataacaatttgttaaagaaagcacaatataaaaaagataacctgtgatcttaataacataaaaagtgaggagaggaaaagtaaaagtgtagaatttttgtatgtaattgaagttaagttgttagattaaatagactattataactgaaaaagatattttatgtaagccctgtggtaaccacagagaaaattacctgttacaggtccagaaaagataaagaaaaaggaatcaaagcataccactaccaaaaaatcatcaagttacaaaggaagactatgagaggaagaaaggaataaagaaactacaaaacagtaaggaaacaatgaataaaatggcaataataagtccttattatcaataatcacttaaaacgtaagtgcattaagttttccagtaaatgacataaagtggttgaacagcttaaaaaaaataaaccttgatgtaattctatactgcctagaatggagtcagttttactttagaaacacatacagaattaaagtgaagagatgagaaaagatattctaggcaaatagtaaccaaaaaagagcaggagtggctatacttatgttgaacaaaatggactgtaagtcaaaactgtcaaaataaacaaagaaggttattatttaaaaataaaagggtcaattaaacaataggatatagcaattataaataatattcacccaacatcagagcacctaaatatataaaacaaatattaatagatctgaagggagagatagacaataaaataatagtaggggactttaatgtactactttcaacagtgtacaggttgcctagactgaaaatcagtaaggaaacaacagacttgaacaacactatagaccaaatggacctaacaagtatttatagaacataccaaccaatagcagcagaatacacattttttttcaagtgcacacagatcattttccaggacagatcacatgtgaggctatgaaccaagtcttaataaatttaagaagattgaaatcctatcaaatatcttttctgaccacaacagtgtgcaatttaaaatcaacagtggtaggaaaatggaaaaattcacaaatatttgtaaattaaataatacattcctgaacaatcaatgggtcaaagataaaatcaaaagaacattaaaaacctatatattttaaatatataaaattattttaataatattaattgatttatttaaatatagaaaataattttgggtggaaataccctaaacatcaaagatagcaccattttagtattaagtgtgtcaatggggaaaagcctaagattttgggtcaagacacccaggttcagacctgaattctatcatttcccatcatgtgatcttaagcaagtaacacatttcctctgagtttcagtttttctcatctatgaatgaagataatattactttgttgcattgttggaatataatctaatatatgaaatgtatcagaaacttattttacttgactagaaataatgttgttaaggcatatgttatagatcccaagcatgggaggtaaacctctatcaaaaaacaaatgtgattaacctacattatatatgtgtgtgtgtatctttctctctctctctctctatatatatatgtatacacacacacacattcaacaattaacagatcatccagactgaaaatcaaaatgtctgtcagagggggagagagggagggagattgagagagagagagggaaagagagaactcctattttactttggtttattttgagacagacactctttttattaaagtatgaatatataagtgtgtatatttttcctgttgatgaagaataatgaatagacattaaacattcatcttatttaaaatctttctattttttcctaatcaaaagactcctgaagagtatcttcacgtgttagcctcagagcctcttcccttgctggaccctgtgagatgtttgtccacatatagtgacttgctgcttgccttccatcatatttcagcttttacagtcaactttccactttcctgaccacctaaaaagtacccagtaaataaccctttatcgctttaccttgtctttatcttttttttttttttttctgagacagagtctcactctgtcatcaaggctggagtgcagtggtgtgatcttggctcactgcaacctctgcccccggggttcaagtgattctcgtgcctcagcctcctgagtagcttggatttcaggtgcccgccaccatgcctggttaatttttgtattctggtagagatggggtttcaccatgttggccaggttggtctcaaactcctgacctcaggtgatccacccacctcggcctcccaaagtgctgggattacaggtgtgagccaccacgcctggccgcctttatcttttacctgttaagagagtagatcttcaatgttctcaacacacacacacacacacacacacacacacacaaaaaaaaaaaaaaaaaaaaaaaaaaaacaaacaaaaaccagtaattatgcgaggtgacggatatgttctttagcttgattgtggtaatgcatatcacaaattacatatgtctatcaaaacatcatatataccttacatatatatagacagaaataattttaatttgccagttatacttcaataaagctggggaaaaaacccagaaatatttgtagaacattaatcatatactaggtagtaggcatcaggaatacagaagttatgatcttttgaggaacttttaaatattaaagagatgccctaaactgggtagtgttttcaaaaaaaaaaaaaaaaaaagggaaggtaaccgtggaaaattcctttttaatattatgcatattttattttgagtaggaactctttctgtgaaagtatcatggggaaagtgttgtattaggcgtcaacttgcttggagggatcctaggactctcttgttcatgattcttacttgagtcttgttctcatgaattctatttgtttctagctacttctcctctttaggcctaatttagtgtataagccttctgctgtcctctaagctgtggttgctagtcattgctcttccattctcctcattacttgccatttgatctcagtgtatcagccatttaaactttttcctttgtcaatggctgccatattattcacttaccagtagtctcccatttcaccctttgtgatggttaccccagtatatcattactttagatacattttatttcaccatgactctaacttcttgcggatgttcacttatattttaatcacataaaatagtcttcattattacttaaataaatgtgtctttagaatttttcaaaaggtattttctatcttaatgttgtcatgcacttggatttgtacacataaaaccttagctatttaagggatgggtataacctatgaaaagatttctcaggtttcttttttttttttattatactttaaattttagggtacatgtgcacaatgtgccggttagttacatatgtatacatgtgccatgctggtgtgctgcacccattaactcgtcatttagcattaggtatctctcctaatgctatccctcccccgtccccccacaccacaacagtccccagagtgtgatggtccccttcctgtgtccatgtgttctcattgttcaattcccatctatgagtgagaacatgcggtgtttggttttttgtccttgcgatagtttactgagaatgatgatttccaatttcatccatgtccctacaaaggacgtgaaatcatccttttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttatagtcgtttggatatatacccagtaatgggatggctgggtcaaatggtatttctagttctagatccctgaggaatcgccacactgacttccacaatggttgaactagtttatagtcctgccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctttcggctgcataaatgtcttcttttgagaagtgtctgttcatatccttggcccactttttgatgtggttgtttaatttttttcttgtaaatttgtttgagttctttgtagattctggatattagccctttgtcagatgagtaggttgcgaaaatgttctcccattttgtaggttgcctgttcactctgatggtagtttcttttgctgtgcagaagctctttagtttaattagatcccatttgtcaattttgggttttgttcccattgcttttggtgttttagacatgaagtccttgcccatgcctatgtcctgaatggtaatgcctaggttttcttctagggtttttatggttttaggtctaacgtttaagtatttaatccatcttgaattaatttttgtataaggtgtaaggaagggatccagtttcagctttctacatatggctagccagttttcctagtaccatttattaaatggggagtcctttccccatagcttgtttttctcaggtttgtcaaagatcagatagttgtagatatgtggcgttatttctgagggctctgttctgttccattgatgtatatctctgttttggcaccagtaccatgctgttttggttactgtagccttgtagtatagtttgaagtcaggtagcgtgatgcctccagctttgttcttttggcttaggattgacttggcaatgcgggctattttttggttccatatgaactttaaagtagttttttctaattctgtgaagaaaggcattggtagcttgatggggatggcattgaatctataaattaccttgggcagtatggccattttcatgatattgattcttcctacccaagagcatggaatgttcttccatttgtttgtatcctcttttatttgattgagcagtggtttgtagttctccttgaagaggtccttcacatcccttgttagttggattcctaggtattttattctctttgaagcaattgtgaatgggagttcactcatgatttggctctctgtttgtctgttattggtgtataagaatgcttgtgatttttgcacattgattttgtatcctgagactttgctgaagttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcacagatagctcttattattttgagatacatcccatcaatacgtaatttattgagagtttttagcatgaagcgttgttgaattttgtcaaaggccttttctgcatctgttgagataatcgtgtggtttttgtctttggttctgtttttatgctggattacatttattgatttgcatatattgaaccagccttgcatcccagggatgaagcccacttgatcatggtggataagctttttgatgtgctgctggatttggtttaccagtattttattgaggatttttgcatcaatgttcatcaaggatattggtctaaaattgtcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttccttgtttagtcttgggagagtgtatgtgtcgaggaatctatccatttcttctagattttctagtttatttgtgtaaaggtgtttgtagtattctctgatggtagtttgtatttctgtgatttctgaggtttctaatttttttctgaaacttttcacttcaaatagaattttaattgtattggctctgagagagtgcaaaccaagttagtactgagtcagcagatggaggaatccttatcattgaacaatgaaacaacttgaattcttttttgccctttttgccatctggtatctgtgctcatatttgaaacattaaccattcaagaaagattttttttttgtatccagtagtcagaatatttctctgaagactggtgcttatcttttcaggaaaaaaaaaagataaaatgttataaatatgaatggagccctgaactaatatttgacagtgacataaaagcttaagaaaatgcagagtacaaagtgagtctaaggagatgccattttcaatttattttcataatctaattctgtattgcttgtaaaggttaatctaaatccagcagaaccaaggctgtccactgtttacttgttataggcactgctacattattctaaatgcagcaagatgaacatggcccttgtttacaacctagttgctatttctttttgaatcatagcagataaagtttttttcatgtgaacttcaaattattagtagtcaaatagtgttcataatggtaaaatgcatctaagaaaacacctagaaaggaatttataatattcactttgaaaatagtgacacaatatacatttaacctccagttattcaaataaccttgcagatcacctttttctggatgtctacctactagatgtcctcaacttctatttgatgaggaagaaagccaaaggaactcaaatagtttaaatattaacttaaataggagcctaaggaaatatctattcaaaactttagcccctaagagttaaacattaccttatgtggtagtaatggcttctagatattctggtgttttccttatgtataaaactgtttatctctatttttcatgagtttttctagtataaacaaaacataaataattaatgtggtaatcatattatgcttgaagccaaattcgtggtctaagtctagatcttttagcatgtgggatacatattgccacttttcaaattggtttgtctttgagtagagtttgaagactatttcctcttgtggttgtgttttccatttggggacttgtaagcaatgccttggtttctggtggagtggatcagtttgagacgttttctctgtgtgaatcactaagaagattctattaactattctttagatttagaaataatttgttcactgaataatcagtctgtgatggacaagtttaagaagattacaaataacactcattaagtaaaagttaagtgttttcttgaatcagcttgaacctttatccattggcttaatctagctcttgtctacttatttggttttgggacagaccctttaactttctctcctaatgggtatttcagatgttaaagagcttttgggcacggggaacagtgatgtgctcagcttggtcatgttatgggaagagggctgaggttgctttaagtagctacagaagaggcttcaaagagaacctcagcttcattccctgtccgttagtaagctacactttccacccagcagctctgattacagtgagtctgaaaatgtctccttcagaaacactgcccattgctcactatttttgcaccctgcctgttacctaagtctctcagtttcttgctcatgctgccagcaaactgtcctctattgaccttggcctctgcctacttggctcctatcactttagggactcttcctccttaatatggattttcaatttgtactctcactgacttctagctgtctccacatctcactatcacctctgccacagagaatgtgtggttgcactgatgggtcttcaggtaggagagagtgccactgcaatctcatgtcaggcttacctcagaggccactgttgtgtatgtgcattagaacaatgacaaaaaccaaaaactctaccaagaacggtatctgtcatttaactcaatgtctagaattcagattactgctcatctcagccctgggaagcagttattattcttatccctgttttaaagatacggaaacaaagactcagagaagctaaatactggcagagctgggactcaaacttagctctgtttaacttcaaatcccttgcctttaaccactgtaatatggcagagaccaggtcacagggtcatgttatccacagcccagagtcctttgaacatggctgccctcagaaggggcctgtaggcatggtagatgccccgaggcttttcaggaggggtgatttcagcaacagacgccttctagcacagataatttcctggcagcacaatgaggctagcatatctatcctgttacatacaatttcttggtggattgaagatgtgaagcaaaactatgctttaaacttcaaagcacttgtgtaatgacagaaatggtagtgggcttgtaatagtaggacctagtacttgtaccctaggcctggaatttattgacctttaaattttggatacatcactcaatgtcttactttactcatcttaataactgggtcaatcttaattttaaaaggacaatcatatggacttaatcttctaaaaaaagattagcttattttgataaagggcttggcatttgatagaaattgagtatactagtaactttttttgtttgtttgttttttcgtttttaattctccaaagaaagactatatctggctgcttaataaagagaaaacctctcaattgaagtgtaacacacacagaaaagtgcagaaataaatgttcaactgaattaactatctcaaaataaactcacttgtgaaaccactttcttactcaagaaatagaacatggggccagcaccctggaagccatttatgtccacgcctaatcactaaaccctcctttttccccagaagtaaccactgtttggatttctaacactatagaactgttttgcctactttttaaagctttatgtaaatggagttatatgaaatgtattcccttgtgcctggcttcttttgcgaaattatgtttgtgagattcatggatgttattgcacgtgggtgtagttcatattaacggcagtagtgtgtttcattatacgaatgtaccacaatttatttattttacagttgatggacatttcaattgctttcagttttcacctattactaataatgtttctatgaatattcttgaccttgtcttttggttagtatgtatacatatttagtctatactaggtatgaagttgctgggtcactagatgtggtatctttaacttgaggagacaatacaaagcagatatcccaaatacttttccattctgtcaatagtgtgtgactgcttgttgttcctaagactagccaaatcttagtattttcagttatttgaattctgatgggtttgtagtggtatgtctttatctttcctcggctactaacgaggtttaatcacaccactttttttttttttttagatgaagtcttgctttttcaccaaggctggtgtgcagtggtgcaatctcggctcactgcaacctccacctcccaagtttaagtgattctcctgcctcagcctcctgagtagctgggattacaggtgtgagcaaccatgcctggttaatttttgtatttttagtagagacggggttttgctattttggccaagctggtctcgaactcctggcctcaagtgatccacttgcctgggcctcccaaagtgctgggattacagatgtgaggtactgtgcccagccagtttaaccccctttaatatatttgttggaaatttggatatcctgctttgtaaaatcctttttcagtctcttgccaccttttgcaaatgagttctggatttttcttattggtagtttgaagtactttattccatattagtcctttgttgattatatgtgttgcaaatactgtggcttcccttttcactctcttgtttttttaatgaaaggaacttcttaattttaatgtagtctaatttattagtttctcctttgattagtgctttttgttgtttgtttggaaaatatttcttaacctcaaaatcatttagaagatactgacttgcatggtctctcaggagttttgttgtttttattttcacatttagagctataatcctcttggacaggtgatagttgtctggctactacatttttttctatgttttcattcacctgtgtcctctttgctttatggaaaaaagtgagactatggcttgaggaagatgtgactctttttctatatatctgtactctttatgactatctttttatacattgtcacatttcctgaacataactccctctcccccactttattaagcatattcgagacatagaatgaatttcttaaataatattttagtactgttgtttcttaaggagattaggacaaaaacattatgaaacacccttgatgaaaacaaagaagtaaatgcagatatatcaagcggtttattcagagagatgcaggttattcttacttttcatagttcttcccaccattctctgccatgccatggactagaaggttctatcctagcatcgctctcaatacctgcacttaatcaacaatgacatctcttccatttgatagtgagtgatatgaatgaagaaaggaggcttcccgggaaagaggcttcctcattttatagcagaacttgatgggcattgcgaaaacacaagaatgattctagtctgtatggaaaagcatggctacttcagtgcctgttggcataattaattttgtgaaaagcttgtacatggctagctaacatataatcatgactaaagctgagagatgctccatcatggaacagacatccttcatgtttcttttgtcttgctattttactttccataccaaacactgttacaaacacaaaccattggtttagcatgaaaaggctgcagtaaggaacatacagatggtggcttgcagcaaggtcttgcacatgtttctcatggacaaaattggcatttttgcaatctcgtgtgcctctggtatggtgattacaaagctaacacttttatgttcctctgaactgtagcatctttctgtttgttaagcatattttttaagtgtaggtcaaaattacaaatatctttttctttgtctgctttctagagttgactgcagaaaatgaagaggtttccaagggacaaggcctatgtgagtctgtcagaggctagactcatctgtgatttactttcctttctaactccttgggagaacactgttttcctgtctctgtgcagtttgcagtttttgaaggacacgctaataaaggcacacttctaaggaagataggaaaggtcaactagtgcttctcaactagttttagaaaacttctggcttctacagctatgtgataatttgcgtagatataattattaagggcttatcctacaacttagtaaaagttttgcgctttttctctagcacatggccttttaaaatgccagtaactttgttaattccaagccaattattttcacactttccaaagcatgatatcacactggtcatgtgtatctctgtattgggatacaataaaacacacacacacagacacacacacatttacttattactttcattctcagagatgatgccattgttctcactattttaatttaatgtgtgcaagcttggtcagtgttacatgttgatggtaaaaagataaataagatacagattctgaccttaaagagattcttacggtagaatatgtatactgatcaaaaattaagctatggactacaatatttttcactttgaatattcagaaaaataccacttaggacctaaaaattatagctagcctattttgaaaaattccccagttctgactgttggccatgtgctagatgtaagcaaagagaagaggtaaataaagagaagatctctgctgtgaaggtacttacaaaccaatatgctacactttctcactttgcatagattcaaaatcaggaagatactacagcagtgcagacaattgttattgttatctggttttgcttaatatcactggatggcttatttttttttttgctttgttttattttattttattttaagttccgggatacatgtgcagaacgtgcaggtttgttacataggtatacatgtgccacggttgtttgctgcacctatcaaactgtcatctaggttttttttttttttttttttttttgagacgacatttcactcttgttgtccaggctggagtgcaatggtgtgatctcgactcactgcaacctctgcctcctgggttcacgcgattctcctgcctcagcctcccgagtagctgggattacaggcacctgcaaccacgccaagctaagttttatatatttagtagagacggggtttcaccatgttaatcaggctggtcttgaacttctgacctcaggtgatccacctgcctcggcctcccaaagtgctgggattacaggcatgagccaccgtgcccagccatcatctaggttttaagccccacatgcattagatatttgtcctaaacctctccctccacttgacccccatccccggacaggcccccagtgtgtgttgttcccctctctgtgtccaaagcttattcttttctttcataatttctctgaattaaaacactattgtatccataactttaaatattttatattctggtattgagcaagtagatgacctttattagattagggagtggagtactaaaagatagtcactctttcatgaaaagaatgcaaagcagaaagttcttgcttctgttgaattttgtataaggatgtctttgtccagctagtgaactgtattacattttgacaccattgcatatctggtatggttttttgaggtaggaatataaaattaataattaataattttgacaaagtataattttttctttgtttttgactgagcaatgatcaaatggatagattactcatgctaatattttgtaatatctagatatttctataaactaagaataagcatagacaacagcagattgtcccagatcatcattattaatataatcatcgtggattactatataaggtcaagatgtcaattcttcacaaattaacttatgggcttgatgcaattctgcacaagattatatgattatctggaacttgaggaaatcttattaaaattcacctagaagagagaaaaagcaagaagagctaagaaaatattgacaaaaaaagtaatggatggaagccttgtcctatgaactgttaaaaactagaacaattcagtgatgaaaaactgtattttaactgtcaatttaatgtatgtataggtatgtgaaatctcaataacatgtatatgaaaaaatattcaaatctaactaaatcctagtcttcaagtatctatctgaaagtctatctttcatctatgtatatttagaacatttaataaggaaatatgcaaggaccatataaaagatctacatcatttattgagtgatataaaattattttattatgtccctagattaaaaagacatataggataatataaatgtacaatataaattatcttatataccctgtagtatactgttcagtacataaagtaagtattcaatgactatttcttaaataaatgaatataaaaagtttgtattgttttgtaattattggaaggcttatttcagcatgaaataaaatctaagtaagtattgatacatagaaagtaattgtcggggtaatttggaaaaaaacatattgtcctaggtacctgataagaatatatatgaaggaggtaggtatattagttaggagtttgcagagaaacagaatcaataggggatgtgtgtatgtgtgtgtgtgtgtgtgtgtgtgtgtgataaatgatttatcttaaggaactggcttatgtaattagggaggctgagaagtcccacaattgggtgtcagcaagaggaagatccaggagagctggggatgtagttctgagaaccagagtgcttgtagtataagtctcagttgagggcaggagaagactcagtcaggcagagactgaattcacccttctccacatttttattctgtttcgccctcagtagattggatgattgggtgcagggtgctttactgagtccaccaattcaaatgctaatctcatctacaaacacccttacagacacacccagaagtaatggttattctgggcaccccatgtcacagtcaaattgacacataaaattaaccaccagaattaacaggaacagaaaaaaaactttgaagtttgccagattacatggtgaaacaggatgagtagaaaaatacttatccaaaaatagtatgttggagaaagagaagcaatcgcctatatttaggccctgaattagatactctttgtctgatagatagggcaatgtcagcttagaaacatctggcatgtcaggtattatattcaaagcaataggatattgggaagacatgcatatttctaaggaagagagaaacttagagtgggacttaatgactgttctctctgagatatgatttattaaaattctttccagtataattactcataaatatgggaaatcaactgcaatttactcccaggaatcaatcagtgccttttcttgctagatcgatcccttgtgggctgctgatcactattcctggatttggaccagtgatgcagagtgcattcattattcattcacttattccttcaataaatatttgtgaaatgcctactcagtgacaacatggtggtggtatggctgccgatttaataggaaacagcacatggcttccagtctcttgagctaagagaatgggaagtatgggggaaggcaggggacacaaatttgtgtgtccaaagaatgtgatgtagggtctgtagagtagctggctaaatttgtaactgcccaaatgggttcaccttacctgctgcctagacagagacaagttatcaagaaaggggaaatacaatagagaaagagtaattcacgcagagctggctgtgcaggagaccagagttttattattactcaagtcagtatcccgaacatttggggatcagagtttattttattttattttatttttttgggagacggagtcttgccgtcgcacaggctggagtgcagtgatgcaatctcggctcactgcaacctctgcctcccgggttcaagcaattctcttgcctcatcctcccgagtagctggtactacaggcgcacgctgccacgcctgactaattttttgtattttagtagagacggggtttcaccgtgttgcccaggctgatctcgaactcctgagctcaggcaatccgcccgcctctgcctcccaaagtgctaggattacaggtatgagccgcctggcccagacggatcagtttttaaggacaacttggtgggcaggaagtcccagtgagtgctggagtgccaggagtgctgattggttcaggtcagagatgaagtcatagggagtggaagctgtctttatgtgctgagtcagttcctaagagcagatgagccagtttatggatctgggtggcaccagctgatctctcaagtgcagggtctgcaaaatgtttcacacacttatcttaggagcagtttagggagggtcagaatcttgtagcctccagctgtatgactcctgcaccatagtttctaatcttgtggagaatttgttagtcctgcaaaggcagtctaatccccaggcaaaaaggaggtttgttttaggaaagggctattatcatttttgttttatactataaactataaactaagttcctcccaaagttagttcagcctacgcccaggacagcttggaggttagaggcaagatggaattggttaggtcagatctctttcactgcttcagttacaattttgtaacggcggcttcaagttgtgtgtagatcataaagtgtgtgttgactacatgaaaagtaaacaataataaagagttgagactaaatcctaggagaaatacggagctattagaagtttttaagcaagaggaggacatggtcatatttatgttttagatggagcactttgtctgtagtacagacagagataaaaatcaggcaagattggaagctgggagataggggctgttgcaacaatttagacagcaaaggttacagatcgtgtacgtttcataggttacatattttggggccttttaaaaaaatacaaaattttgaatgcaaaattagatgtgaagctctagaaggggtcttaagactcatgagttttattctacatccacctttagatccagtgaagtagtttacgtggtctgaactatggtgggggcagtaggaatgaagaaagatgaatgaaaggaaatctgaaaaggaacttggtgattggatgtgcaaggtgaggggagagaactatcaaggaccatgcttagttttctgtcttgtgcaatcaattggctcgatgaaggaagggtctgttcattgagacaggaaacacaggaggcagagtagattttggtggcaatatgggaagtgaagttttgcacccaggcaaagtagaagtgattgtgaaatattcaggtgtgaagctcaagatagtgaaattatcctacttctgatgaggctcaattaattttggcaacttgggtgttcagcatcctgaggatgaatgtaatgccccatcaagtgtggctcccaaagtaggtgtagatttaaattttgcataatccgtagttcagtgattattgccttgaagccctattgcctaggtctgaaaactaatgctgggttatgtaggactcttactgtttttctcacccttactgtggtgcctttcaggatgattttttttcctggtcatgttgcactgtaatactgggacatgtgctgcttagctagcaggttaccctgaaggcttttagttcattggggaggatgaatttttggttgtatgtgtagggtttctgtaatgtaggtcagtgtctgagctccctttgattgttaatccatagtcttcaactgattatgcaacccacggaggacctgataaatataatgttttaaagttcagcagcaaatttccttctccgttgtcctttgatttgaaaatggctgacaaatttttcttacagtttttatgaaagtgaagacagatatgactaccaacgaatataaaaatctccccaccaggaaagttttagactgtcatcaaatgacttaatataggagataataatagagtctgttttgcaacctaaaatatagtattttctactatgaacactgtaattactatttacagctagattatagggaaatctgtgggtgtcatggaattcagtttaaaattatggaaactctgtttgcataattaaaaggctagttaataaattccctcctattttctaacctatttaagcagatcatatatgtaccaatatttctctgctaactatggtagagaagacaaccaactttaaatcttctgttgctgaataatacccataataactgtgtataatatatggctcataattagtgaatatgctgagctttttcaagaaatgcattagatatggcatagatacaaatttctgcttcattaaatgactttatggactatattttgctgcttttgcacatgtgatcttttcccctgtttgatagcaagattactttacagctccttaatgagaatatctttttttttctgaaaccttttctgaagttttattgaagctctgggtgacctatttctaacggttttagagctctaacattttctctcccttatttaagtagctttaacttatgtttgattagtggttttagaagtagattcataatctaattttaggatgaaaatcttttcttacaggagaaaacaaatttaaaaataaccttacatgtcacaaggtgcctatggattatggaaatggctcacattcccggggcacttattgggtaaagagggtgaaagccagagatgacttctcttagttgcattttattcttagttgcatttctgcaggaaaatttctctttattaagaggactagaaaataagttcattgatgggtctaaggaatgactgcaatacaatgttaggtgctgtgatgtcatagtagtatagaagcagagatgagatgctaataccgggtatttgtagaatgggtgggaggtttccaggtgtccaggtgtcccatatttaaggaagcttaatattcacatttgaattttggagcagctatgacttaaatatcaagaaatattgtgataaatgatttgagccctgaaagataaataggaatttacctaccacagaagatggaaaaaggctggagcaaaaatttagaggcaacaattcatattataatttttttagttagagtaaattttaattttagttctaaaagaaatccacacactttagcaaactgaaacaatacagacatatgtaatgtaaagaggaaatatctactttatgttgttgccctccctatccccagcctctattcatgcctctctccacatgtttagtgtcgattctctgagagcttttcctatgagtttactcatttacatatctgtgtgtgtgcatgcatgtgtgtatgtaattagtttcattgttatgtaacttgcatcactcaatatgccttatcgaccatttcctgttagtgcatttcagtctactctatacattttaagaactacctatcaacatggtataaatataccataatttatttaaccatagccatatataaggtgtttacaattgctatggactgaaaatcaccccgtctgtaatttttatgttgaaatcttaacccccagggtgatagtattaggaggtgggacctttgggaggagatcaggtcatgaaactggagccctgctgaatgggattggtgcccttatcaaaaagttggcaaaggatatgaacagacacttctgaaaagaagacatttatggaaccaaaagaatatgaaaaaatgctcatcatcactggccatcagagaaatgcaaatcaaaaccacaatgagataccatctcacaccggttagaatggcgatcattaaaaagtcaggaaacaacaggtgctggagaggatgtggagaaataggaacacttttacactgttggtgtgactgtaaactagttcaaccgttgtggaagtcagtgtggcgattcctcagggatctagaactagaaataccatttgacccagccatcctattactgggtatatacccaaaggattataaatcatgctgctataaagacacatgcacacgtatgtttattgtggcactatttactctagcaaagacttggaaccaacctgaatgtccaacaatgatagactggattaagaaaatgtggcacatatacaccatggaatactatgcagccataaagaatgatgagttcatgtcctttgtagggacatggatgaagctggaaaccatcattctcagcaaactatcgcacggacaaaaaaccaaacactgcatgttctcactcatagatgggaattgaacaatgagaacacatggacacaggaaggggaacatcacacaccggggcctgttgtggggttgggggaggggggagggatagcattaggagagatacctaatgctaaatgacgagttaatgggtgcagcacaccaacatggcacatgtatacatatgtaactaacctgcacattgtgcacatgtaccctaaaacttaaagtataataataataaaataaaaaaaaaagaggaccaagggagtcatttaccctttctgccatgtgaggacactgtgaaaagaaggctctctatgaaccaggaagggggccctcaccagatagtgaatctgcgggtgccttgatcctggaattacctttccgtactgtgagaagtaaatttatgctgcttataagctatgccatttatggtattttgttatagcagcctgaatgaaataagacaactctttttctatattacaaataattctgcaatgaacttctatatccataattatctcctaatttattcctctatttttctttcctttccctcttttttccttctctatcttcactcactctctccatcacactctcacatttatctaaacaaaatctttgtgcacatttgtatttctgtagaatggatcctggaagtggaattgctagaacaatttaaatattgatatgtattcctgaatttcccttccgaaaactctgtaccagcttacacttccatcaaaatttggtcgggtttatttcatcattaatcatggatatctttgcgttttcgatgggaaaaaatgataaatagtatttaaatctttttgttgtttctcctaaaatggtgaatttgaatttgaacatcttttcacatgtattttggcccagtgaatttccttaatttttcttgttgatttttacactaaattattttaaaaatgatttttagaacatctttattcagtttggctattataatttttttctgctgtatgttttgcaaatatgtcctttaagaaatgtttattttctatatttttttttgtggtagagaaatttttaattttgatctagtcaaatctgtcatttttttccttaattttttctgtattatttcttttatgtctcttgcctaagaaggactttttcagatcaagattataaaaatattcttaaatttttttttgtattttcataggttttttttttactttaggtttgaattcacatggaatttaattttaatttgtatataacatagggtatggctgagatctaggtaatcaccacatcgatctcattttctttgtatgtacatagttagattttatttcccagtcttctgtgcagttgggtgaggccctatgactaaactgtaccatggaatgagaatagaagtaatgtataccacttctagtcttggctcataaaaatctttcaagagagatcctctgtgtctatcctcttcccaaatggtcttggaggccaggtgttgaagatgatagagtcaaatttgaaagagtttagatcccagaattaccacttagagaagagtcatacaccaatcaggaatatccatttttgactctatgtgagcaagagagaaacttctttcaatagctttaagccactgagattttagggtttatctttcatagcatttacataatcaatacacagagtaagattgtgacttaactttttccaactgtcaggtcaattgtcgtaacacactttatttaatagcttgccatatactctgtaatttgaaattctacttttagcatattctatattttcataattttaggagtgattctagattctgttttgttttattgagctacgcatttattcctgcaacaatgccatgatattttaaccactacggctttgtaatttttcctggtatctggtagcagaattagcttttaaaattgaggcgtgtcttgttcctttaaagtctttctgtgactcttagaatacaatagaaaatctctaacatgatctctaaagccctgcatgatttagccactgtctgtctttctagatgtatccctccttctctgcttctcagctgctttaattttctgaaaatgtaaagtatcttaggacctctggaccttcacaaatggaagtttcacaaatatttttccatttgcctgaaagagttgagtgtatccagataaactcttgctcccatatgactttgatctgttatgtaaagagagagaagtcattactgattccatgtagtcatgaagacattcttaagtataaataacttaaggacatgtgaggtcacatggaaaggaagaacttgacttggagaattttgaatttttttccatatctgacccatagatgaatcagttctccactgacatcacatgtttctcatcatgtaaataaaaaatgatgaatatcaaagttttctttagaaaccctggagacattgattgtacactatgttgtgtgtggtgtaagtatgaaatttaatggaacttttaagtgtatggcttacaaataattaacaaataatttcgatgtctaatcttattgcattaactataggcctgttcaagagcaaaaataacactgtatgtaagttttacataaaattatagaccttttccacctaggggtaccgtctgtctcaagctcctatatattgctgtataagtgaaggttctggcagcaaatagcacctcaaacagtgtaactgaagagtgttttataggagatgacagacaatggtgtggggaggggaaaaagaaatgaataagagatggtgcagtgctccagagttggtactgatggggtcctgttaccagccccaaacctgagagaatcaggagagagagaagttactggaagttgaaggccaggccacctgacagggaccatccctttagtataggtgcttaactaacctgcggtgacgtggcagagagagccataggaatcaatccttgctcctgttctctttctactctatggtcttctgctggagtcttctgttggtcaaacccaactggaagctaaaggggaaggtagccgcattaataagggctgttaagctcttgaggttcaaagctgggtaactaaggatagagaaaatttggagggagaaaagaaaatatcctgcacactctgatgtatcttgaatttatgtttttaggattcatataggatgaagattaatttcacatatttccaagttccaaatcaatacttacaacactatctgttgagcttgactttccatattactttctgaaccccttcgaaattattatgcataatagagtatgttctggagtatgtggtctgggatatgtttttcactgttttgtagtagttttataaaatgcttatttgattggataagactttcctatatttttttccagatttaagagtttcttttagcatttaatatagatctagatgattaagtgttttcaaactatataaaaaaataacttgtttctctgctgtgtgttgtacttttacaaatatgtggagcattgtatctagtgtgttataggcataggtaaacagtaaagtatggctgaataaatgaatatacatttatttaagaatatattgaagtatatatgttcaaaaatactagaataaagcaatgtatactacagttaagattggaagacattacatgacatttacttaaataaagacagatttatacacggaaataacaggatgaatggttctcatgtaaataggaaagaccaaacaaagtgtttactgatacacttgatattattaaatacatcatataaaagattcttaccagaatgtaaaaggggacacatgtaaattggatttcatatccagatacaagggtacctcaaggtgtctgggcacttctgccagtatcagctccagagagaattcaggtactaggtgtctagtacaggactgctccaagatgcagaagggattctgaacttctcaggggaagggggatgccttcaaagcttctgttttatctatctaggtcatttctattactcccctcaactccttatcttattgaattatctctcttatccacctttaaaaatttagcttatgtttataccacttaatcttttcttttacaaattctttctcaatctgcagtctatgtcctcagtgttcctataaattcttgggctggtggcatcaccatatcatcatcctcctcatcatcatcacagttgtgatcaccatcagaggctgatatttgttcaaattactatgtaccaggtatttggctaaataatttatatgagttatctcatttaatttttacaatgaagtagatattataagtattcctgatttagagatacacattgcatactgtttataatctgttcgactcatcttcctctctcaacagtaagttcattgaggccttcagtacatcctttatcttgtatctttatatccctggccttaagaatagtgatcagtacatggagttatactccaaatatttgaatgaatgttggtttagtctattttgatttaatttctagacatagattttatatgatcatttaaaaatagagtgacactttgcttcctatgcaaagccacaacatttctggaacaataatttattttattaaatccactaaaatatttgtcaaattaaaataaaatccctcttgggttttagttctctgttctctatgtgtatttaattcaaattggatgaaagactgatgatcatggatttctgctattgaagaaaatggaataaaagacttcttggcaaaacagtcagttttttaacttgcaaattaaattatagtgtagatttgctatcttgcccccattaacttcttgccctctttggctatctgagtcccgtggggatcagatttcccgtagcccagtataacatgctattgatcaccccttctgctttgccactttcaccttccagtacaaattggcctgtgtcaagtggaggaggaacgtggagggggaagataattaatttaccctcacattgaaattagatgcattctaaaaggaggcaatcatctgggcttggatccctgaggatctaccaattttgggttgtaaattcctcagctaacttattctaaagtatcaggagcataagtaaatacatttttcatacatctgtgtgtactggggtgaaaaggattggatggtaccctgaagtagaacctagcagtgaccttttcaaagtttttacacagttttagtcacatggtgtcttgaagttgaaattatgtactctcaaaatattggaaacttctttgaaaccatggaaacagcatgtgagatgggggatgactggacagcagaataagaccttcctattatgactattgttctttcactatgaatatctaaaagtgtatcttcataagtcactttcttctagttatagctttgagaacatcagtgcttttagaatcaaagatattgtcacaaaaggaagcgcaagccatggaactgtttataatatgattataaacaattctttctctaatacttatagttctgctttcatgctaaataatgtatttgaagatttgagtcagtaatcttcctaagcagagtgacaggagcctccaaggcatatatacaaggctgtttcactattctgcagcatttcagagtgcctgttatttaacgcaatacagataaattaacatgcaataaagcttccagtagtgatactaatttacaacaatggtagaacaaaaatgttgttaataattgtaattcttccagagggtttacttctcatttcactctattatggcagtgaaaatgtgtttagggagtaacagagtaccgttctccagaacccagtagcagtcctcttaacgttatacgtgtggtgaatccctaaaatttaaaatactccctgaacttttctttttcttttttttttttgttgttgttgttgctgttgttgttgttgttgtgtctctgccaagttttggaatcaagatgatgctggcctcacagaatgagttagggaggagtttctcctgaattttttgcagtgctttcagtaggaatggtattagctcttctttatacagatgataaaattaagttctgaatccatctggtcccaggcttttttttgtttggcaggctttttattactgattcaatttcagtactcattattggccagttcagggattccattgcttcctggttcagtcttgggaggttatatgtgtccaggaattaatcaattcttctaggtttctagcttgtgtccatagtggtgttcatagtagtttctgaggggtttttttttttcctgtggggtcagtggtaacatcccgtttgtcatttttgattgcgtttattttggatcttctgttttctttattagtatagctagtggtctatctatcttaataatttttttcagaaaacaaactccaggatttgctgatcttttgtatggttttcacttctcaatttccttcatttcagctttgattttggttacttcttgtcttctgctagctttggggttggtttgctcttgtttctctaattcctgtcgttgtgatgttacagcggtaatttgagatctttctaactttttgatgtgggggtttagtgttataaacttccttcttaacactgccttagctgtaggactgggcaaaaatttcatgtcaaagacaaaaacaaagcttgacaaatgggacctaattaaactaagggacttcggcacagcgaaagaaactatcaacagagtaaacagtctaccaaatgggagaaaatatttgcaaattatgcatacaacaaacgtctaatatccagaatctataaggaatttaaacaaattcacaagcaaaacataaacaacccaattaaaaactgggcaaatgacatgaacagacacttttcagaagaagacatacacatggtccataagcatatgcaataatgctcaacatcactaagcattagataaatgcaaaccaaaaccacagtgagatatcatctcacaccagtcaaaatggctattactgaaaagtcagaaaatagcagatgctggtgcagttacagagaaaatggaatgcttatacgctgctggtaggaatataagttagttcagcccttgtggaaagcagtttggcaatttttgaaagaacttaaaacagaattaccatttgatccagttatcccatgactcagtatatacccaaagaaatataaaatgttctaccttaaagacacatgcatgcatgtgttcactgcagcattatccacaatagcaaagacgtggatcaacttaaatgcccatagttgatagactggataaagaaaatacggtacacatacaccgtgaaacactatgcagccataaaaaatgaataagatcatgttctttgcaggaatgtggatggagcttgaagtcattatcctaagtgaactaacattgaaaaagaaaaccaactactgcatgtcctcacttgtatgtgggagctaaacattgagtacatatgcatgcaaagaagggaacaagagacatcaaggcctacctggtggtggagggtgggaggaggatgaggacggaaaaactgccttatcagttactgggtttattacctgggtgacgaaataatctttacctcaaacccctgagacatgcaacttacctgtgtaacaaacctgcacatgtacccctgaagctaaaataaaagttaaagataaaaaataaaaaaagaaaatactccttgagaatgatgtgggcagtagggaaaaaatttgggttcgttattgaaaagcaataatttatgcataaggagaccccaattgttttgatcttgtatctaagttatgtttatctcagtgaattcttggcctaatgacctttctattcctcaattaacacatttagtaaggattatagtattggtcaacctctccatttggaagaaagtggaatgcatagatgaatttgtcttagatgagcagcttattaatttagagtaaaagatatgtcacaaccaattctaggactaggacattttcattgctgtcactcataggttatttaaaaggtgctaaaaaactttgaaaagtgaagcaacttgtattaaaatctgaattagttcaggtgaccttcagaaaccaatcactttaaatcacatttctaccttgctgtgataaaaaaatctgcatgtaatgggaaaatttaatcactaataacagatatttttagctatataaatcagttcaaagagcaataattgagcattgctgtgtaccaggcatattgaaggtaatcaaaataaagaaaacttagtgtctgatcttaggcattattatttaagtaaacaagctggataaatcttacttcaaggagaggactctaggaaagccttttttttttttttttttttttttcaaataaatggagtatgactggctttctggctgccagagaggaggatagtaaatggagattttgctcagtgttcctatgataggttagttgggtttgtgtgggctaacatatacctccaaaatactggggagcacattctgatcagtccaatagtcagcaatgttacacagagaggtccttctgcttgatgtgatgattccttctttttcaaaccattgtcaacttttctctggggccaacatagcctggcgacaggaaacagcatactaaatcctgccactgtgactgaacgtggagatagagaaatgcttcgtaggaaacccagatgcaaaggtgtttgctttcacaatttctagaggaagaagttgactgatcaactgaaactacccaatttgcttaatcttttgaattttgttcttcttatgctttcgataactacattaaacaaggttaaacatctctaaccacctgagtatgaaaatgagaaggggctgggtgcagtggctaacgcctataatcccagcactttgggaggcctaggcaggtgggtctcctaaggtcaggagttcgagaccagcctagccaacatggtgaaacctcatctctactaaaaatacaaaaattagacaggcatggtggcaggtgcctgtaatcccagcttctcaggaggctgaggcaggagaattgcttgaatctgggaggtggaggtcgcagtgagccaagattgcaccactgcactccagcctgggcaccagagtgatactctgtttcaaaaaaaaaaaaaaaaaaggaaagaaaatgagaaggatgggaactttgtcatatctctctttatcaccagtgtttggcaaagtgcctggcccatagcagtgttcagtaaatgtatgataaaagtatgaaagaaagaataaatgaatgaatgaatgaagcctgatttgatctaagcccctttaaattccatgtataaataagattagctttttttacctccttcagcagaaaagaccaatgaatacaatcactaattgaagttctctttgtttgccaactttttaattaattgaaattagtatgactccttgtcctctcagtatcttgaacaattgttggcatataatagtgctaattgcttgcataaatagatgaatgctctggtgaaagtagacactttcatcatttccaatccctacactctaaatcctgacctattatttatatttaagtcccttattttctatgaaggctcacctcatctcattctttaacacagtggttctccttcccttggaccttgtgtaaactatcttttttatattttttattggcatctagaaatgacggtgatttaccttttctgcttctgggaatttatcattaaggcaaattttaaaatactgggcaagttcttttgaaagatgtttattgcattgttatttttaagagtgaagctgctataccttgcttcaatagcttaagagtacaaagtaagataaaatcttttaacttcacatccaacgcatctgagctgctatcctgctttctcttcccagagttcctcttccaagttgaggacaaggtgtccaggcatatttattgagcccataaaagttgttattataacttcatggaaaaagatctgtaaaatctattcacttcatcaaaagacttgttctctgtagctgttagtgttgtcaccatgatacggaattacttctgaaaaaaggaagttcaaaattatggccttgaccattgctggaatcaccatggtaaacaaggaacccagctgttaccaacttggcaattgtttctttgtgtgcagggccagaagatacttttccttcccaggtgacattattgtatgcttgcttcataccaaaatatacatgggctcccaaatgttacaattgttagtgactagctcattcagtgcatgcacctggctctttttcccaaggcacaccatagtggctgcatactgaggggcttcagcctcagccaaatgttgcataaacagctctttcttacaaaattctagagctcgaggttggtccaaagtttacatattttttcaaatgagttttctcttaggggcgcctgtttctttcccatgatctggcttcacatagattctgatagagttaagcatcctaaggaaaaggctcttcttcttttagaaatttccttgactgtatataactctttagggcagctggctttgtgggagaggagcattgcttaattccatcaactacctgtattttaggtcctagacacttatatattaaaaaaaatctgcaatagtcttagatagatgcatgctgctttatgttgtaaactgaagcgtcattcattttaccctctccaaaccaaggttctttccaaggtaactgatatctttaccaggaaactactaacaacttttacacaatattttcctcactgaaatgttgtaggtagcctcacttgggacattgctacactagtatacaaaatggaaacaattcaaaggtccaaaaataggatcttaagcatgtaaagtggttggtacacttattcaatttgatattatgcaagcattaaaattaaagttatgaagactttataatgatattaaaaatgctatgagttactaagtgatagaagcagaggttaagtcacaaatctgtatacatttcactatctattccaagatacataatgtaaccactttgacgtatttttaatttttggaagtccattactagaaagtcctggattgatcaaatgcacacacaaaatctagagaatgacgtaatacagttcctggcttttcacctcaaatcacttttaggtccattatgagtccgtttggatggagatcaagaagtcttttctgtcttgggctgctctgttttcctgttcccttaatgtcccattatcttcactctttggctattcagggttaaacttcttgttcctcttggctcactgaagtgctgtttagtttgccatttttctaaaagctggtgcacgtatgtgtgtgtgtgtgtgtgtgtgtgtgtttatctcaaagacacatctcactcctgccttatggacaagcatccataatacaaacacatttttaaatactaagataatcaacttcttagaatgtcattgttctctttgttttgcttctattttgctaacgtggttggggtctttatggacccttacatttctacaaaaactaatgagataagaaggaagccccatcttcccatatttagtaggggtgggatcagaaaggaatcttaccagaatatttatagtacttttattagatagcaaattgcatttcatttttccatttttccctgatttccaaagtgtatttatgttttatattactttcacgtcaaagaaaaacatgcaagaggaaattatggaaacttagagaatgaaaaaacttttttttttttattgataaggaagttgaattccaggtcaattaaaagaggtatccaaggtaagtgttgatgacaaaacctaaattcttaaaacagctccaccattttctagctttattacatagagaactctgttttcctttccgcacctcagttttctcatttacgaaatgaggctaactggttaggttgtggtttctatgcagtttacccatgatatggcacatgtaaagtgtttagcaccaattctgtcacataatgggtaatggatacatgctatttcccttccctcctggttgtataaattcctggtgcagagccttaccagcataccagcaagaatcccctcttgagtcactgtaattactctgctttattaaacttatatacagtgtcttctgttatgggctaaattgtatccacccaaaatttatatattcaagccctaactcccagtacctcagaatgtgacattggaggtaaggcctttaaaaggtaatgaggggcctgacatggtggctcatgcctgtaatccctgcactttgggaggccgaggtgggcggatctctggaagcaagagttcaagacaagccttgccaacgtggtgaagtcctgttgagaggtgacagcctgctggcagtcctcacagccctcgctcgctctcggcacctcctctgcctgggctcccactttggcggcacttgaggagcccttcagcccaccgctgcactgtgggagcccctttctgggctggccaaggccgaagccggctccctcagcttgcagggaggtgtggagggggaggcgcgagcaggaaccggggctgcgtgcagcgcttgtgggccagctggagttccagatgggcgtgggcttggcgggcccgcactcagagcagcgggccgcaactaggggcttagcacccgggccaccggctgcggaggatgtactgggtcccccagcagtgccggcccaccggtgctgcgctcgatttctcaccgggccttagctgccttcccgcgggtagggctcgggacctgcagcccgccatgcttgagcctcccaccccctccatgagctgtgtgtggcccgagcctccacgatgagcaccgccccctgctccacagcgcccagtcccatcgaccacccaggggctgaggagtatgggcgcatggcacgggactggcaggcagctccacctgcagccccggtgcaggacccactgggtgaagccagctggactcctgagtctggtggggaggtggaggacctttatgtatagctcagggattgtaaatacaccagtgggcactctgtatctagctcaaggtttgtaaacacaccaatcagaaccctgtgtctagctcagggtttgtgaatgcaccaatccacactctgtatctagctactctggtggggccttggagtacctttgtgtggacactctgtatctagctaatctggtggggaggtggagaacctttgtgtctagctcagggattgtaaacgcaccaatcagcgccctgtcaaaacagacctctgggctctaccaatcagcaggatgtgggtggggccagataagagaataaaatcaggctgcccgagccagcagtggcaacccgcttgggtctccttccagactgtggaagctttgttctttctctctttgcaataaatcttgctgctgctcactctttgggtccacactgcctttatgagctgtaacacgcaccgcgaaggtctgcagcttcactcctgaagccagggagaccaggagcccaccgggaggaacgaacaattccagacgcgccaccttaagagctgtaacactcaccgcgaaggtctgcaccttcactcctgagccagcgagaccacgaacccaccagaaggaagaaactctgatcgcatctgaacatcaggaggaacaaactccggacacgccgtcttcaagaactgtaacactcaccgcgagggtcctcggcttcattcttgaagtcagtgagaccaagaaccccccaattccggacacactgtctctactaaaaatatggaattaaccaggcatggtggtgcacctctgtagtcccagctactcgggaggctgaggcacaagaatcccttgaactggggaggcggaggttgcggtgaaccgagattgtgccactgctttccagagtgagactccatctcaaaaataaaataaagtaaaatattaaaaaataaaataaaaggtgattaggttaaaatgaaggcattagggtggacactaatacattctgactggtgcccttataaaagcagaaaatttggtcacagggagagataccaggtagtatgcacagagcagagactataggagaccacagtgagaaggggtccaaaaagagatttctcaggagaaactagacctactgacaccctcatcttggacttccagccttcagagctgaaaaataaagttttggtgtttaagccacccagttcatggtatttttgtaatggcagcccaggcaaactaatacacctttcatctttaaataaaagttagactgcttaaaggaaaatactgcattatactcatttgtaatgatagcaaatgatcaataatttcctgaaaaaactgatttttattaagtgtggaaacattgttttatatttctttgagttctcccatggagacctagctattgaggttattggcaactataatgtgataatgaggattatcagtaatctttttttttccttttgcaaaaagtgagtagaattgtgctttttatgaagtcataggagtaaattcatttagagctgaaaagattattccttattgcctgtacagacataggtagagataattaaatctgtaaatgtaatttctaaaattaagattaatgaccaggaatgtatgattccctcatatgctgatgacctcatgttgtctgaggctaaatgttagggcttctcaatatctttgtattaatgactatgattgagttattttaaatgtagtcaggatacaagattaacttgtctatgttggaagtttgtcttgtatttttcagaggatcaaaaataggcaatcataaaacgataaagtcaaaggatttttttactgagctttaaaaattgcatttgattctcattttttgaattgtgggaaatgtgggaaaaactgagttatcttaattaatttatggaagggacatcaagagatgaaaaagttttgcaaggttttcaacatttgccaagcctaaagctcaaatgcaaagttagcgtaaatgagaaatgctctgaacagtaggttatcaagtttattaatgagaaaaatgcagaaaatagtgcttaaataagtgagaaggctacttctttctgagcagaaatgttgtttgtatatcctttcaacaatgcaggtacgtatatatgcatatatacaaggaatatttttctaatgtctcattatcttaacttgctgaataacctttgaatgttaattaaaacctcagaatctcattcacacatctataaataaaagatattaaataatcttcaacataccttctaactctagaattttatagttttattgtatccagggttatgaataaaagaggacaacagatgcagtgtcacttagggaggctacttgtcacacacattctgctggcaccttaatgacaatctctgcagaaggggcagtgactaacttatgagtttgaacaccaaacctatccttcaaatggtgggagttctatttcctgctgaatcttcaggactagaagaatacttgcaacacggaagacatccaatacatttgtcggataaaggaacagattaatatttcgagtgctttttggattgttatactctattgtggtgtaatttcccatatttttaagggtcatgtttacatatgtctagtcaattatatttcgctagagagctagagaattagagaaacatgatcacttgttgctgctaaactaaactaaatgatctgaaacatcagcaacattttaaagaatcttttgtggtgttcctctcatatagaaaaccagaaaactttgtcttgtctttcaatttcttccttcatatcttctattttcttctcttatttttacccaactctactgttgctagggaaagtatgtattgtctgaatgtaaactctatgaaggcagaggcactggctgtcttttgaatacacctaggacattgcctagcaatgatgatactaaaagatatttgtttaatgaatgaatggtaacatttataaccacagaaagataaaataatgtctggctcactttttactagtaatggggaagggtagcctggaaggaagggagtcatgtatgtatgtacatttataatacatcaagagagatatactgtaatttccattttttttttcaaaaaacaagaactctttgtgtctcattattttcttggtcaagttatagtgagaatgttcatgagaaaaaaaggccaaaatttaaactgctcaaatttctagccattcttttaaaaagcttgatttcaaaagggtatattgtaaattttagccatatggaaaataagaattgaagacaacagaattatcctcagtatgagttgcctcagacatggttcttctagagggtagcttagcaatggccttcccctcaggtaattatcacaacatttctgtgcatgtctgagtgtggtgcacgctttctgtaacttaggagcctgagatagctgaaaagctatgcaagtacaataatcagaatgggaaccagccaggcattctgactcaagagggataaaaaggaaatcagctgcctaatgaggctctttctttaccccctgcccttgtgaaaaatagaggctacagtatttcattatgaatctgtgtgcttcgtttctcaccctaccttggtttgggaatcaaaggacatttctgttaggtctcacccttggagctctcgtccttactcatgccttgaactattattacctctatgcaggtgtcttcccaaatctgtgtttcaagtcacatcttcctcagcccttgtcgtcactgtcctgcattccaactaaacaatttttatttttatatattgcctattttgacgtataggtgcagactttaaaagagtcaaaattatatacaatatttcatttttttctcaaaaagtaaattattaaacttaatgaactggacttttatatttttcttcttagcagatgtgttgcaaaagatcaaacttttttgtttttttagaagtagggagtgtcagagcaacttgctggctttctttttttatttcctaaataaaagcactgagtaagtgtggcatgtacatcactttaatgttgagactgcagagtcatattgaagagatttattctctccttgaattcgactctgaaaatagcttgtactaacatcaggaactttgcatcctcatcttcgtaatcatatggttcctacagtcagatttaagacagagagtttattgcagctgaaaaaattattttaaaatgtgaaagactagttgtttactaagacttttccataatacacgtgaagtttatatccaagaagcatgtttttgatcaagtatatctaggcattatttatatgtttcagaaattcttaaatatttgtgtatatatgtctcagaaattcttaacttttataaactgcaacttagtcattctggttttatatcaagtcttgctgagatatttcctttacctgcccaaatcctagatttaaatgagtttgaaatatatttaatttacacccatctatgttataaaaatatttgaaaggtatatgatccatggtgttgaaactttacttctgcagggaataatgtccttctggagggactttctcacttacaaggtgattttctccaccacggctatcaatccttccttaccatggtagtaatggtggcaaagggaggagctgagtttgtctttttggccttagattatctagatatgcatttcttcttctacagctatagaaaggagatcatctccattgccatttctatactgtaagcattcaagactctggacttatttttgcctaattacatggttcctctctacctcagtatggttgattatgtattctatttccttatgtagtatgtcacactggcatctctccatgaggtaagtgcttttcatctacataaaatgagtcccttttgccatggagtttcaccagaaactgacaacacttgcctatggtttagctgaacaacgtatatatttttatcataaaagatatcttttaaaagtactatatattgaaataggaatcattaaaatttattaaaagagattttagaagagttccatgaagatatttgacaagaatgtttgacagtatactttgggagagaccgaagtaaagaattcctctacataagtttcttgggaacctgaggttttctctcctgtgctatatttagatgtgtggcatgtctaattttctgcttccatgcctcactgttcttctagtgcttatcgtaatccagctaaagtgtcaggccgaagtgtggagaaaacattctgtcctgagtaagccaacttgcagctgtatgaggaccctctgtgccagtcaccgtcatcctaccattcacccatgcattcctgacattctaaacagaagtcgataaatgttttctcagtaaagtaattctgaaaacttaattctaaatgttgtattaacttagcaagacttgaagtgcctggaatgctggccatgtaacttggttgatcagagggtaccagctaccagttcaatttaaataaatgcagttcagttcaagtcaggccaatttggttcaattaaactcaattcaatacacacctattgagcacctgcatggccaaatactgtgttatgttctcagtatatggagacgaataaaatacatttgatgtctgcaatctaacaagcagcgtaagcaaacaaataaaataaactgaatgtggtttaataagtagaataatagaattatctacacaatgctgaagtaaccagtgtatgaagtaattaatttttttaagggggaaaaatgccacggtggacctctattaacttcagtagggatgacaccaggttcaagaggctgaagaagagacccagagccagcaaatgggacatagagttgaagtgaaattacatacaacgtggtaaccagtgatggcaggctagacagaagaactgcattgcatccagaaatggtccagtggcaggggctgggcaggagaaccacagctgcttgcgaaaggcatgcggtttatacagcgttttcacttagcatcctcctcctaacaacctacatttagcaaccttcatttaacccaaaacaaaaggcgtcactctcctgtacagcctgtgttccatgggatggttcaggggttcaggtgttcctcatagataaggaatgggttttgggttggccactcctgaactccttagctaggaactctgaacacacattcaggtatatctcccatacagggtcattctcagggtatgcttaaatttagttattgctatcaggtgtgtctaccatacagggcactatggtgaagggcatctcaacaaatgtttcctgaaagaaattagaaattatacacaaatacgattttgaaagatgaccaaaaatgtgctgagttttagggtgtggtcaagtttagacaaagggaagaacactgaatacactcctccatggtgatggatagactcgtatgcacatgatactaatcttggctattttaatacagttacttattcactgattattttcaggtgcacacattgtttcatccataccatggcaaacacgtactagatcaagcgaagtaaagaaatggattaaggtatcacatagccaagatacttgatatttgatatagcggtgtagttttttcaaagagaagtcatttaaaaatctcatgttttagcctcagctgcttttctctctttcatgacctttcaattctgcctaattattagcactgacacagtgctacctgactagtcagcacacttgctgataaaggtgcatttcttacacatttttttttttttttgcatttcacttcacaggccaagatttattaaccagcgtctttagggaggagtctcatatgaagacttcaatgcttttataaggacatactgtactacatttataaaaaaaagtactataaataatattacaagaggcagtacagctcaggtggctctaaaataagctgagtgcagagtctgtatgatctaagatatatgtcgctccaccacactcagtacaacctagaggttttctgcctttatttcattctctttatccatcaattcagggtcagtttcacaaaagcttaaaatccttcacttttcagtaaaagatacaagaaagggcacctctggctggcatggggaaggacctttccattttatttgatgacatatgattattactttattaagggattgttagaaatgatgatacagatgtctgattgatatcctaggaagattgggaaattaaaaattggacacatatagatttaaagctcagctcgtcactcaatagctgtgactttgggtgataaggttactttctctgggcctggcacagtggctcaagcctgtaatcccagcactttgggaggccgaggcgggccgatcacaaggtcgggagattgagaccatcctggcgaacatggtgaaaccccgtctctactaaaaatacaaaaattagccaggcctggtggagggtacctgtagtcccagctactagggaggctgaggcaggagaatggtgtgaacctgggaggtggagcttgcagtgagctgagatcatgccactgcactccagcctgggcgacagagggagactccgtctcaaaaaaaaaaaaaaaaaaaaaaagaaaaaaaagattactttctctgatacttggttttcccatctataagatgagactaagaataacctcagggcaggatgttgtgaagatacactgaaataatatgtgtgtgtaaagagctgaacaatatctgttgcacaaaatacatgctcattaaatggaggctatcataaaaataaaaaagtgggagcaaaatgtcacacacaaagttccagtcacatcagtgaatgttctgtttcccaagcaaatgaatgtagcatactttctggggagtcaaattctcatttccaaatgggtggcatttcaactctcaatcctgtgtgttaaattgacagtaaaagtagagcaaaacttgacttttttagaaaaaatatctgtgaaaggatttttttttcagtaaaacagaatgtggcaaaagtttttggttgttatatgaaaggtaactactaagagaaggcaggaagatttataagacataagtaacaatctttcagaacagtaatagtatgttacaaacacaaataagagaagccattacaaaaatggaaaaggatgttacttttcatgtctggggcatgtttttaggggaacatgttggtatgagtgttcagcatgaatatctgtgattatatgagtatgctgtgattacctgactgatagtaagcctgctaatgcagttgatgggagtggagagtgctggtgtggagaggtgggggatgaaattgcagcctccgagacaatatgtttttatcctgctgtacatttccacaaagtcaaataactggtgatattggactctggaaaaagaaccagtgactttctaagccaacaatcccaacttcaggcttacaaaattgtatgtagtccttggaacagccatcaaagtcattccatgaataaaaggggctcccattgccaataagtttggaaatgctgaatattatgtctcaacacactacatgttggcatattaaacactctgagaagtcctgccatagaaaggaactaattagcgaatagtttttcattttttttcttctgagacagggtctagctctgttgccctggctggtgtataatggcatgatcgtggctcactgcagccttgacctcccagtctaaagtaatcctcccacctcagcctcctgagtagtcaagattacaggtgcacaccaccatacatggataattttttatttgtagagatggggatcttaccatattgcccaggttggctggtcttgaattcctggcctcgagcaatccttccaccttagcctcccaaaatgctggtattacaagtgtgagccactgggcctggcctttaacaaatagtttgatgatttcctaattgtaacactgtatccctttatcaagaaacttttacaaacatctttttgagctagtgacctagaaagcacactttgaaaaatcctgaatttggcaaccaggaaaaaatatagaattatacatatggtaatatacagtgagctgttttggggagatgaacatttataattttatatctcctaaaatgtacaccttatgctgtgaaggatgtagtggaatcttttggttctagcttacgactagctgaaaaaaaatttttgtactatcacattaagcaagaaccagttatttcatagttttattttgcacattaaggcacaggagataaatcttactgtctgacgaaatccttttcaagttttgttctacagtttccaagtcctgatgcagctttcttcttaagtaaaactatttccttaatttgagcaattcgccaggttgaagaaaacttgtaagcactgttagtacttgtcaggagtaaatgggactctagagagttctttgaaataggaaacatttgaacagaatatcatcttgctttcagctgtttgtatagatgcaatttctgcaattctatacctcacagctctaatttttcttcttctgtgtctcaggcttccatcaataatccttccactgaaacacacttgacaagagaggtagagtagacgcccttgcaatatcttctgaatgtcactcagcagtgatttgtaatcgggtttatatattttaaggagaaaaatgtaaaactaaatagaagattcaatccatatgaatccagattggacaagggtactcttagtaaaattttataaaatcaccttttgattggacagtggaaattttgtaaaacagaaaaaaaaatcagtgattttggattcctattgtggatctatatctacaaaataaaatcgtctggtaatacaccttattgtatgaatgaatgggctgttttgaggaccagttacatccaccttgtactgtgatttttaatacatgtttctaagctagaacctctataatacagttgttaccttgtctcgtaacatcagtattagaataaaggtcctactctgtgtgtatactttaggtaagcaacaagattcctcctgctgctcttctgaaattcagggatatctggactagagcctaaagtcctttgttatttgaaaattaagtttgaaaacccaataaaaatattctttctggacagcaaaaaatattacattaatttcatttgatttggatctttctgtttacttagtgaaagctcttaaaagcctattctgattattttggaacaaaattttaaaaaattaagtacatttttaaagtgatgccatatagttctctctcagtttatacagggactatatactcatattaagttttcatcatttgtttatggaatagcattagaactttctgggaaaaaatatatatcctggaccgtgtatctcaatttcaatatatttatgtgtcctgtgtgtgtttagtcacacaatgaaagaatagcctatgtaaagcattgtctggaagaaggggtgatgagtttataataatagcctttgactaaatataaggattagatgagtttggtatgtgaccataggctatcgttctactttctctggagcaaattgcactgtttgaggaattcctgtaagctcataattatagtagataagcattttacaatttcacatgaagatctaaattgactaattgaaagaggttactttaaaagtggtgaaagtgatgagacctatacgcccatttaacatgaactctaatttccctctgttgaatttgtgaatttacagtcattcttctccctttcattcaactcttcaggggtcaaagatttctaccctgttggaagaagccactgttgaagtgtgaaaggctactctgctttctgcgtccatttaacctttggcctgccctaaagagccagccaagtgtcaatcagggctgattgggcacctgtgcctggaaacaagacagagaaatttagctcttccaggtcatcaaaccatctccagatggcaaagaacttctgaagttatgaacctaacttgcttgtgatgcaaattagtgacctagggtgagatgcttcattaatgcttactcctgtgagcctccaaggtgtcagaagttggactgcttactctcacattttttttttgctgtgtaatgtgcattaaaataatttatattcatagagatggtccaataaattgcatatggctagttaataagctgctaaagcagagaagaaaattagatttcatttagaagaaaacaatatttggctttccccatggaaatatgtgaaaaagctttagaaaattctgttaacattgaggtctcagaagagactgtgattaaaaataataaaaagaaaaaaatatgaatttctatccagatcactatttttttatccaagtgatgagaaaaattatgcaaacccatgcatttgccctgagttatgattgtattatattaacctcagctgacaatatcctatgctagctttggcttacttagaattctgcctcttgggtataaacacacatctgaaattgactcagctcatttctttcttgctggggtcactttactggttactcccaactactgaacttattttatgtgttttcttttttacaatattacattctaaaatttttatcacctaagaattcctctctgatgattttattactcaattcaagatctataattacgaccaaatctcacagataacaagatgctaagatgggctaataaggttttgcttcttttactttattcaaggtaaagtactggttagagtgaacactgcccagtcatttgcaagcaatgttgggactatcaggagtggcttgtattttcccataaactatcctagtgcagtagaaatgcctgacagtacttgatggctggtatctttggatctgagtagttcagatagaaaaagcaattatcttagcaatgtctgagaaagatgtttttgaaatttcattactaaaaataacaggtgctaataataaatataaaacagtaaatatttgagtatctactttgtgttcaatgccatgtggatcattttttcagtagtattgcttttcagcagaacacattaggtcatttggtaccagagtgtgtaaccatggagtctattttctataaaataggagaaagcttactctctgctcaaattgactgaaaagctactgccagtggatatttgactcttgtagaattattctttatagtgcatcaggtggacaaaaaagaaaggattcacagagaaaaggtatgaattattacatgagttttagtgcagtataactgttggatgattctttattctagttatgggtagtgctttgaaagattaatttaagactagtcctctccagaagttcatgatagtagaagattaggctagattctataaataaattttttatataattataaaaattaacatttatactttagaaattataaaaataatttaatttgaatccatgagtgaattcaatatgttatcagatacatgtttcttttcatttttcctgatataataattataagtagggtattctctaattgttatgactgaactatctgattctgatgctgatgcaatttctacattaatgtaatcaaatagatgtaccaaactaagtggaactttcggtatactggaatgcttattgtattgtcagacattttggtattaaaccattttttatctatgatgaaatactacttggccatggtgctattctctcaagttcattctcacttacttgtcatactttccttcatgtccttcaataatatgagctatctgagagggcatcccgtgtagtcacattactttatgtaattgcctcacctttttcttcagattacaacaaagcatttgccgtgctttatcgctaaagtcataattattttccatgtcatagatctttattattctccaaagtccactttttctgttttaaatgaaaccaaatctttccaaaaatttatgcttatagaaattcttcagaatgtatattctgtaatttgatttaaagtatacaaaaattcagattatctatatatttaattcaaacttttaaaattctgattgtctgtctgcttccagtaaaagtgtttcttcagctgtcataatccagaaatatggcaatgttcaccaatctatagagaaattaaaagtatctgagcattcattgttgttttaattttcattttcctgatgacatatgatgtggagcatccttttatatgcttatttgttatctgtatatcttattttagtgaggtgtctcctaaggtttttggcacattttaaaatcagattgtttgtgtccttattgttgagtgttaagattatttgtatattttcgataacaatcctttgtttgataagtgttttgcaaatatttctcccagtcaatggcttatctttccattcccttgacagtgtctttcacaaatttatactttaatgaagttcagcttatcagtttttttttcatagatcatgcctttagtgttgcaactaaaaaaatcaatgccaaacccaaggtcatctacattttctcctgtgttctggaagttttatagtttttcagtttacatgtaggtagaggatctattttgacttaatttctgtgaaaggtgtaaagtttctgtctagttttattgtttttacatgtggatgtcctgtccagcaccatttgttgaaaagataatccattgtattgcctttcctcctttgtcaaagatcatttgactatgtttatgtggatttatttctggactctctataatgttctgtggatctatttatctattcttttgccattgccatacttttttgattattgaaactttctagtacatctcaaagtcaggtagtgttagtctttcaactttgttattttccttcaacattgtattggctattctgggcattttgtctttccatagaaactatagaaccagtttgtcaatatacaaaaatgactttctgtgatttttatttgaattgtattgaatctatagataagattgagttgatatcttcacaatattgagtctttctgtcaatggacatggaatatctcttcatttatttaattctttgatctctttaataagaatttgtggttttcctcacatagatcttataaatattttgttgatttattcctacatattttattttctgggatgatagtgtaagtagtattcagttttttatttaaaattccacttgctcattgctagtatatagaaaaatgcttggcctttatgtattaacctgtttatcctgcaaccttgttatagtcactttgtcagttccagtattttctttctggattctttcaatttttctacatagatggttatgttatctatgattaaagacagttttctttcttttttttcaatctgtgtacctttttttccttttcctgtcttattgcataagataggacttccagtaccttgctgaaaagtggtgatgagaggagaaatccttgccttatctctgatgttagtgagaaaggagtttctcactgttaaatgtgatgttagtgtgtaatgtagaaataggtgtcagatgctttttctgtatctattaatttgatcaggtgatttttcttttttaacctgttgatatgacagattgtattaattgatttccaaatgtaagcagtcttgaatacctgcaaagtggtggtagtgtgtaattatttttgtacattgttggattacatttggtaatattttgttgagaatttttgcatcttttttcatgaaagatcttggtctgtagttttcttgtactgtcctcatctgctattagggtaatattggcttaatggaatgagttagaaagtattctctctggttatatcttctgaaagagattgtagagaactgacataattttttccttaaatccttggctgaattcaccgtggacccatctgggtcgggggctatctattggaaggatattaattattgatttaatttctttctttctttctctttctttctttctttctttctttctttctttctttctttctttctttctttctttctatttttttttttttttttgagctggagtttcactcttgtaggccaggctggagtgcaatggtgcaatctctgctcacctcaacttccacctcccaggtttaagcgattctcctgccttagcctccagagtagctgggactacaggtgcccaccaccatgcctggctaatttttgtaattttttttttggtagagatggggtttcaccatgttgaccaggctggtctagaactgctggcctcaagtgatctgcctgcctcggtctctcaaagtgctgggattacaagtgtgagccactgtgcctggctgagttttctttataaagatagacctattcggattgcctatctcttcttgtgggagttttggcagattgtctctttcaagaaattgactcatttcatctaggttatcaagtttgtgggtgtagaatttttcatagtattccgttattatccttttgatgtccatgggatgtgtaatgatgtctcttctttcatttctgacattattataatagtaattttcgtcctctctttttcttttgttagttagcctaggtagaggcttatccattttactgatcttttaaaaagaccaaactttttgagttttgttgatttttttgattttctgtttttaattatatttatttctgttctaattttcattatttctcttattccgtttgctttggatttaatttgctcttctttttctagtttctaaagtggaagctcaggtgactggttttatattcttcctattgtatgcttttggtgctatacatttctctctaacgaagcactggtggctcatgcgtgtaatcctaccattttgagagggtgaggcaggaggattacttgaagacaggaattcaagagcagccttggtaacaaagcaacacaccatctctacaaagaaaaaaaaaataataataaaaattagccattcctggcatggtggtgcacatctctagtgttcctgctactcaggagggtgagatgggaggatcccttaagcccaggagatgaatgttgcagtgagttatgatcaggccactgcaacctaccttggctgacagggtgagaccatctcaagaaaaaaaaaaaagatttcatctaatcactgcttttcttgtatgctagaaattttgataagctgcatttgttttttttgtttgtttgttttcagttaggtgcatttaaaattctcccttgttatttcttctttggtccatatgttacttagaagcatgttgtttaatctctgagtattttgggatttttcagctatctttctgttattgatttctagttaattccattgtgatctgagagaaggcattgtattattttatttattcttcttaatttcttaaagtgtgttttaaggcccagaacatggtttattttggtgaacgttccgtgtaagcctcagaaaaatatatattctattgttgtatgaagtagtctataggtgtcaattatacgcagttgatttataatgttgttaatttcagctatgttcttactgatatccttcctgctggatccatccatttctcagggaggggtgtttaaggtcacttatatataaaattttaccagatatagattgctcaaacaaggaagttaattaatgcactgaatcattgaatcaagataaagaaatataacaatggtttgtgatgattggatgaaaatagcagcctcaaatgtaatggcaataaacataatcctgatttttcagaagaattagcatggcaacattttacctaaaaaattatgaacattttattggcctacaacattgtttaatgtaagggccagaattgtgagtccatttctcaatatatgtagtcaactttatagtgtttagatcagtgcattattaattccattattttatagataatttgaatctcattaatttcttcagtttttcaaaaatattaattaggcacctggtagggacaaaataaagtctttaagtccttgaatgctttaaagatatgacaaacagcctatcctaaacaaaattactttctagcaggagctactatacctcactcaaaatacatataatagcagattaataagttttgagtctatgaaaagacataaagatatagaaaagctgctgttgccttttacatgaaggagagattacttccagctatatgcatcagagatgacttttatcagaaaagcagcattttactttgtgttgaaaattttaaaaattggatatgagggatggaaggcaggacattctagacaacatggtggaataataaaggatatgcttcagaatcagaaagatgccttgccaaagtcttggtgtcattaaccagctggcagtcattatttgactcagattttaagaacacgtcttaaatcaccatcacttaatcctatcgttccacattatttctttacatctaaaatcaatgagaatctttagaaggaagaacctataaactctaagtataatgtagtgttttaaaaaactgtaaaaacctttatttctaagtttgatttagtaatcatcttgctttctgtttagaaaagctagaaacatcactaccttctttatagatgacaatgatatatcttatgtggttaaacattaccaagtagttgccttaatcttggagaggaataaaggtaattaaaaaattaataaagctgtcaaatttttgtaatgagaacccctctattttttaatgtctcctgtattattacaagatgatcatatattttactggggattagagaaataattattttctgccttattaatcctgcatagttggatgtaatcgtgatgtaataaatacgttaaaggaggttctcccagtttcttttctataaagttatcttagttacaaatgctttttgacatttgcattattatagcatcttttttcctaatacaggcttttttattagggagggggaaattttaaatttcctttataaaatctctctgtcctcaatgtgagatgcccacagtaagcaaacataccttatatccacattggcttcgtgaaacatgagtcacggttatagcaaaactcgctaaaaatggagcctataaatttataggctatataaattggagcctatatatattaaaatggagcctataaatttatcctttataaatttaaattaggaatatattttctctggcttaaacagggaggaagaagaaaagagggtaaaactcagtgctgtccatgcatgaagttagctttggtaattgacttttgtggtactaagatactaaactacatagcttcactaaatgtgaggctggaatgagaagggtatgcagtaattagttactttgactttttttcacatagcttagcatttattactgtttctctcattgctctgacctaaatcaatgacctttaaaatgaaatatatttcattgagtctggtataacccctaccctttctatgattattatacataatttttttttaaattaagtgactcaaaatatggaagacgcccatccatggaagaggggctgtttttaactttactgaaacatcaagaagtagtcattatgataaaatgtgtgcctcatttaacttaagaaatcaaatgtgacatttatgatcaaggcgagagtaaaaaactcatttattatacatttagttagatataatttattatttaaccaaagtttttgggcggatggtcaaataaactaaaagaaaaaatgaaaactctgagaggaaaggaaaaaaaaaagattcttccagtagaaatgatcttttgctctcatgttgccataagacatttaggtttggaacaggttggtttttaaaaagcagttgttacagatgaagatcaacctgtagtcattttaaaatcatctttacaggctatatcagctaaagtgcacttcagttgtttcccccctcaatggtttaatgctagacttacaaaatccgaatccttgaaaattaggtcccaggatttttaacatcatcctcagtatattaaaaaactcagaaattttaaaaaccactgatttaaatggattattttttcttaaggaaaaaatcttattggttttattttacacaggataatgaggtcttttatgttttatatttaattcttgaatgcttttatataatgagaacacggagaacttttactagaatttttgtgtgtgaacatcaaatagatgcataaattcaagttatcatatgttcctacctgctcaaaactgtagccatgaaaataatgaataacaatggaaaagcaagtggacctagaagatttcaaacttaagataaatattgctgagaacaagaaaaaaaaaaatagaagagttacaacatgaatggggccaaagccatagagattctggtctcttgatcccatatagacagtggcagtaggaagtgtgatacatttagggtaaaggggactaaaagttctctacacaggaaggaaggaagaaaagaggcacatgagaaataagtttactgcttgaaattaaggcctgggatgggaatttctttcaggtaaaggaaactaaaacaaagcaaagctcatgtcagatcattgcttgcagctacagcatttagcaagctgtttttccggtagggaggatttatgtacataccacttcaagatgagaaactaaaaacaattccaaaggtggatgactgaatctgtgatattctcagctcaccagggacagaaggatgttgttaaatgtcattataagacctggtttcagacctgaggttggggctgggaagaagcaattacaaagttactggagaggaagggatgaacacagagggcaaaggaagagatagatggatagattattgagaatgcattcacaagtctcccacaatagtccagatcacatgaagatggctaatgctaaaacacaatcagaattaaatgttgaatttgttctacatgaaattaattttatggaacagtctgaggaaaagtttaaaatagacgtaaaatgacaatgagctcaaaacaccttccattttaaaagggtactaaattataaagcaaaatgtagaaataaaaacaaaaataggtgaatattagaaagaaccaattacaaatcttgggtattaaaaaatcagtaaaatattaattaaaaaatttaatagatgggataaattcaaaaatgtctatatatatatatatatttagtgaattgaaagtggtactgaggaaaacattcagaattcaggagaaaaacaagtagtggaaagtttgaaaaaacgctgtacaaacgctgtcatattggattagggtcaccctaatgaccttgctttaacttcattactactgtaaaaaccctccctatctccaaatatagttctcaggtactagggttgtggattttaacatgaatttttgggagacacaattcagcctataacagcatggaaaatatttaaaatgctgtaaggatacacagaaatgagaatttttagtacagtggtcattagaaatgctaactggcaaagccatgttggagagcaatttgaaaataatatgtaaatttaatgatgtatttatctttcatccagtaattctacttttagatatttataaaaagttttgcacatgggcacaagttagtatgtataagaatgttctttaagatggagggatatactacatcactcaacaaaaacaaagctgttatacaaaaacataatgctagctgaaaaggtaagttgcagtgttataaacatattataatatccatataacaaattttaaaacatgacaaggcacagtggttcatgcctgtaatgctaacactttgggagggcaaagcacgaggattgcttgagcccaggagttcgagaccagcctgggcaatatagcaagacttcacctacagtaaaaattaaaaaaaaaaatttagccaggcatgatggtgcacacctgtagtcctggctacctgggaggctgaggttggaggatagcttgagcctgagaggttgaggctgcagtgagccatgatcacaccactgcactctagcctgggtgacaagagtgagaccgtattaaaaaaaaattaaaaatatgttactttctctattgttattctacaagtatgtagaatagctcaaaatatgcatacttttgcaaatactaagttcaaggtattatttgcatcctaagatgaaagaggtgagggaatttgaatcatggatgaataccagttgtggtagggagaataatggactcccatatatcaactatgtgcccattctaaccgccagaacctgtggctgtcacgttacatagcaaagggaaataaagttggcaaatgaaattaaggttgctaattaactgaccttaagatgaagagattatcctggagtatttcagtaggcataacataattaacaaaggtccttaaaagtgaaagggggaggcagaagagtcagcatcaatcagagtgacacaatgtgtaaaagacttgactggccattgctggctttgaaaaggaaaggggccttgagccagggaatgcaggcagtctctggaagttgggtaaggtaagaaaacagattatcccctggagtcttcagaaggaacacagccgcacggagaccttgattttaggcaagttagatgcttctctgatttctgtgttattttgggccatgaagttttagataattcgttacagcaacaatagaaaactaataggagttcatttgtttctgtaacactttattacttaaaaaaatacaacttcatcatataaatcttatgttttctttcctattacatcagcttgcacaatgtcattttcttattaatctccaatttataggggcttcatagtgacagctagaagttggagtaagatgaccagctggccctgtggaacatccaatgcctggggtgtttgaaatcttgtggatactttggatagtgtccagacaaatagcagttatgattacatccttacactgttaaatgttcagtgccacagcttgctttggtctccgaagggatcaacaattttcttatgtggcaaattattattattttatttagcatatttctacaattacgttcggctacaaaatattcatcattaggggcagatatgataaagctattaactgctgtcaagaaacatggatagttttcttaggaaagaaaaaagaacgataaagatgttcacaaattggttctttccgttctgctgcaactcctgtctttgtgaacgccaaatatagctaatggtccaccacatattgcttaggcactaacatctaatttctggttatgctttatttcccataatactttatatttccaataccactttgtttttcttccttcaactctctgccatccaagtcttctacttgaataattttcaagaaattttgggttgtaaacaattggtagtttcttccataattatctttcccgtaaccaaatgtattttaaattgctttcaggataagtttatttatgttttcatcttaatgtactcttgtggaccctgttaaccttaaacatttgcttgacatctggcatttttttaagtctctaagtatttacctcttaatctttgccttttgctatgaatatatatgtctgagccttcatattataatactcagcgggttctttatctgatcctgttgaggacacaggcaattttttccaatgaggaaaaagggcacaatgaaatctcatgactttctttttactgaaggagagaatattttgttctgtattaccagaaaatgaaaagaaggaaacttgaaaagaccactcctagtattttcctaattttactcatagtaagttggagaatggggacaatatttttaaagaagatagttgagaaacattatttggtaagtgctctaacatgaaattaagacgactgcttcttttattcggtgaaaattcctgtagagcgtagaatagtgctgtaaatttccccctccttccctttctctcttccttcctttctccttttcttcttcctctcttcccctctccctcctcccctcctgctctcctttccttcttcttccttcctcctttctctctccctccttatttcttttcctctccctctttatattttcttccttctttccttcctgccttcctgccttctttcctcactttcccttttaattttctttctcatctctttcagaccatttccctttttcacacatgccctttgtttcttaaatctcttaagtccacctttatttttcttctgtttagcaatctctcccattctttttgctatcttgtttctgtactcacatacttttccttataaccttcatatgatttatttccaggctatttctacggtaacaatactggttcaggcctaaagcactacagaggcacagtgaagtggtttatgtcatcctttataatgcaaatccagatataacagagttgttgattgcctaccatcttccccccagccctccacctcctctatctatgagtatggggcaaagtcatatctttccaaatggggtagaggtgggggtggtgtttgtaggtcaagagggcgagcttcaggcaacatatttagggtagtgggagaacaggggatgagtcccctccagatctagaattcttttgtcccaatcttcctggtaaagctgacaaaagggcagcaacaaagtgggagattcctggaataattgtccctgtcctggaagtcgtaggcagtctccaggacccggaatcatctccaatgttacttaaactagagggataataatggttgatgactgaattaactttaatattttctgatcatgtcctgtcttcactcataaccttacatagttttcaaaattttgctttcaaagatctccaagtatttgcactcttccctataatctattatttctctagtccaactatcctttctaacccaataaaaacccaattaatactatttttgtataaataattttggaacttcctatgcttatcatacacacacacacacacacacacacacacacacacgtagaaagagaggttctcactctgtcatgcagtgtggagtgccatggtgacatcataactcattgcagcctccaactcctgggctcaagagatccttctgcctcagtgtcctgagtagctgagactacaggcatgcaccaccatgcccaactaattttaaaatccttttatagagacagagtcttgttgtgttgcccaggctagtcttgaactcttggctcaaatgatcctcccacctcagcctcccaaagtgttgggattacaggagtgagccaccgcatgcttcccagggcgtatttttgaatcgagcacatatcttcctttatctcatcctgcttaatcatttaacctattctaatttcatagctttctcttatattcatgaaagttgtatcttcttacatgctgcccaaaggattgctcaaagtttcctgtaataaatcaaatagtaacatgcctttcctctgacagtcttgggtgaggttccctttatatagtgcagtatttttgaaattttcttttccatgttcttctgtttattgatctttaggtgatgagacagcctattctgatctagtatttgctggcaaatgggtagggaacttgtcagctgcttttggagctccatttaactgctggagaaattgccttctcagattaccagggttcgagttgatctggttgtttctgtgccaggatttcacagacttttactaagtgcaccctttagcttaacagagatggaaccttctgaaccttgctttaatttttaacttaaaaaaatacaattatttacattattaaaattattattttagttaatttttattcaggcataactcatataaagttctaaactttaaggatgtaactcaatgactttttgcatatgtataaacaaatacaactaactgtcttccatgtcaggatatggaacacttagagcatcacatacagctccctaggacatttttctagtcaataacatcccctctcatctgtggaggtaaacacccttttagcatctatcaccattaatttatttttctattcttgaactttctatagaatcatgcattattgcctcttttgtatctgccttgttgcatgtagtgacagttcttttttaaattatttatatgtattatcccgtgtcttaacatatcacaatctatgttttcattttactgttaatagttatttttgttgtttatagcatttggttgtaataaataaagtagttttgaacattcttgaccatttcttttggtgtacaaatacactaatttttcttgactggacctaggagtggaattgctgggtcataaaatagcatatgtttaactttggtcaatactctaggtttacaaggtagttttatcaaactacactccaatttgcagcatataaaaatttcagttgctctatatttttcccaacatttattatgttaaataatttttcatgttagtcattgtgattgatgtgcaggaaagatcttgttttaacttcatttctttaatgattacattgatgtttttatcacactgtattagtccattttcacactgctgtaaagaaatacccaagagtgggtaatttataatggaaagaggtttgactcacagtcccgcgtggcggaaagaccttaggaaacttatactcatggcagaaggcgaaggggaagcaggcaccttcctcacaagttggcaggagggagaagtgagagcacaggaaaaaaaaaaccaaaaacctgccacttttaaaaccatcagacctagtgagaattcactcactcttaggagaacagcatgggagaaactgcccccatgatccaattaccttcctcccttcacacgtggagattacaggttcctccctcgacatgcagggattataatttgagatgagatttgggttgggacacagagccaaaccatatcacacacaaaatacacacatacacagtatcactttatcacttttgctcattaaaaaattggggtgcccatcttttcatgatttgtagtagttttttacgttctcctgatgtgagcccttttatcagttttctttctttgtgtgactttcatttttattcttaattatgttttggatggtcagaatgtctttaatgaaactgaatttcccatttttttaaaatttaaatatatatatatatatatatatattttgagacaaggtctcactctgccacccaggctggagtgcaatggtgcgatcttgtctcactgcagcctctgcctccccggctcaagcgattctcctgcctcagccttcagagtagctgggattacaggcaccgccacaatgcctggctaattattgtatttttagtacagatagggttttgccatgttagccaggctggtctcaaactcttgagctcaggtgactcacctgccttggcctcacaaagtcctgggattataggtgtgagccaccgcaccagcctcttgatcattcccatagtcatgaagatagtttcctgttttcttagaaaatttattatttaacatttaggtctatgatccatataaaattaatttctgtctatggtgtgaagtagcaatggttcatgcttctcaatttatatatccaattgttctgaaaccatttattgaaaagactgtcctttctttattaaaacatacaggtatctttaaagtaaatcaggcaaccaattatatgtgaatctgtttctagactttaatctgtttaattggtatatttgtctatctttttgaaaataccatattatcttaataacagtcacttaatataagtcttgaattctgctaatgtaagatctcagtttctattctttcaggattaccttggctattttaagtcctttaaatttttatatcaattttagaatcaacttgtcattttactgtcacacaataaacatgctgatattttgattaggattgcactgacactgcagatcagtttgaagagaattgacattttaacaacatccaatatttttgtccacaaatattgcatatatctgcatttacttaagtctcttaaaatttctttcgataatattttattgctttcctttgtagaggcttcatatagattttattagatttactgttatatttgatatttttgatgctaggtaattaccattctttttaaaattatagtttccatttttttcttgctagtgtataaaaatatttttgtatccataaaccattaattcactgtgtctattaatttacttttaatccttattgtaggtttttaaatattttttacatataccatcatttttctttcttttctgttttcaaacctaaaaggaagatcacaagccaatacatcttaaaaacatagatgtaatttataaacataaattactgataaaatagaatattttcttcttaccagtaaggtgctaattgtaaaatttttgtggctaaatttatcagatttagatagttcctttccattactagtatgctaagagcttttatcatgagcagattttagattttctgaaatgattttgtgcatatatcgagatgataaactttaaaattctgttaaaataatgaattacactgattgattttcacatgttaattcaaccttgcactccttcttggtaatgatatatactttatatattgttgaattcaactcataaatatccatttagggttttacgtctatggttttaagaggtattggcttgtgattttccttttatgtaatgttgtttccagattttgatatcagagatatattgatattatgggcagtgggaagtgttttctctttttatattctttggaagagtgtgtgtgaaatttgtatttttttctttaaatgtttgatagaatttactatggaagccatctgggcctggagtattctttgtgagaatttttaaaaagctttattgagctataattgacatttaatacattacagaaattgcaaaacaattttttaagttttgagatacatacatacttgtggagctatcactacaatccagataatgaacatacccatcatctttaaaattcctccctccacttctctgatcccagtaaagacatttattctgtcactatatattaatatgcatttttataatttttttgtaagtgaaattacacagtacatactctttattcctggcttctttcatccaacataaccatttaaatattcattcaggttgtgtgtatcagtatcagtagttttttcctttttgtcaatgagtagtattccattgtacaggtataacacagtttatctatttacctcctttgcattgtttctttaaacactgtttttttacctatttacctctttttgggttgactccagtttttgcctattacaaataaatctgctatgaatattcatgtacaagtatttgaatggtcatttgctttcattttttcttgggtgagcatgactagatcaaatggttggtgtatatataaactttaagaaagtgtaaactgttttctgaaaatgttgtaccattttatattcttaccagctgtatataagagtttcagttcttccacatccttatcaacacctggtatgatcagtcttttaaattttagcccttctaatagtgatattatagtatctcatcctgattttgtgtttccctgatatctaatgatgttaagaatcttgtcatgtgctctgtagcctttgtcatacttatgtatatatgtatgtatctatctatttaatttgctatttttttcctactagtctgacttttctgctcattgtacatatattgtgctgctggaagttgtaaaggagtttggtgattctctctgttcattttcttaaaaatcctctgttctttctgttttgtttttgatattttctattgctatactttaaaaccttcccataatttcatctattgcatttttaaattctataaaattatggttttcatctctggaagtttcaatttgattcttttttatatgttctatatcgctaattaactttttgaatatatggaatacagttatccttaatgttttaatttcatctgttaattttaacatctgtcagttttagtttggtttcaattgattgttttttggtttccatttattgctttgttctttgttatggattatattaccctgcttttttgcataactggttatctttcattggatgtcagatattgcaaattttacctttattggtactatttttctattataaatattcttgagcttttgtcccagatgcagttaaattacctggaaacagtttgattcttctggctattactttcaagatttgttagtttggaccagaaccatactcatttagggttaattatttctcactactgagataaaacacttgagtgtgctctactcattgtccacgaatcatgattttttccagttttgctggagaaaagagacactattccgggtcctatgtaagcatcagacattgttatctctaacccttttagcttttctccttggcctcaggcaatttcttcaatcaatttcctgatcagactcagctgagtactctgaagttctccgaatttccttctctgttgctttctacactctggtactctttctagaaaactctagttgctttggtgtccccagactttcagcactgtctcctcaactcaaggagtcccctgggctctgccaggatttcccctctgcactgctgcctggaaactctctaaaggtagtaagctggggcaagagtgggtctcatcccatttgttttgtatctcccagtgcaaaacaaatgttttgatgtcaggcctcatgtcaagtttcatttttgaataaaactcttgttccaaatattatgttattttattggttgattaaagtggaaggtaagtgatatggtttggctgtgtccccacccaaaatctcatcttgagttgtaacctttataatcgccgcgagtcgagagagatcaggtggaggtaattgaatcatagagtggtttccccccatgctgttctcgtggtagtgagtgggttctcacaagatctgatgattttataagtgtttggtagttcttcctgtgttcattctccttcctgtagcctagtgaagaaggtgccttgcttcccctttgccttccatcgtgattgtaagtttcctgagccacccgctacccagccatgctgaactgtgagtcaattacatctctttcctttataaattgcccagtcttgggcagttctttatagcagtgtgaaaacagactaatagagtaggtaatggtcgtctgtgaaaaaggttttaattacaagctaaatttagtttgtcttagttttaaaaatatttatttttatttttgaaaattaattttaattgacaaaaattatatatattgtataccatatgatgttttgaaatatgtgtatacattgtaaaatggctaaattgaggtaattaacatgcattattttctatactttttgtggtgaaaacacttcatatttactcttaatgattttcaagaatacaatacattgttattaatggtagtcaccatatggttcagtagatcacttgaaattattcctttgatttagctgaaattttttgccctttgaccatcatctatccaaccccctacccccactctctgtccctgttaaccatcattctactgtcgcttttttgaattcaacttttaaaaattccacacgtaagtgagatcatgtggtatttgtctttctgtccctggcttatttggcttaacataatgccttccaggttatccatgttgtcacaactgacaggatttccctctttttaatggctgaaaaatattccattgtgtgtacataccacattttatttatctattcatcagtcaatgaacatttaggttgcttctgtgtcttggctattgtgaataatgctgcaatgaacatgggaatgcagatatctgttttacatattgatttcattttctttagatgtatacccagaagctaattgttggatcacatgatagttttatttttaactttttgaggaaccacgatactacttcccataatgtctcttatattcctaccaacagtgtgcaagagttctcttttatccacatccttgccaactcttattatttgtctttttgataacagccattctaataggtgtgagatgatatctcatgtggttttgatttgcatttccctgacgattagtgatgttgagtgtatactggttggtcatatgtttccttctgagaaatgtctgtaaaatttattcacctattattaaatcaggttatttgttttcttgctattgaattacgttccttatatatcttagttattacccccttatcagatgtatggtttgaaattttttttctcccattctaggtcatctccttactctgtttgtttcctttgctgtgcagaagcttttaagtttgatgcaatcctatttgtctattttgcttttgttgcctgtgcttttagggtcatatccaaaaaataattgcttagaccaatgtcatggaggttttcccttatattttcttctagtagttctagtttcaggtcttaaaatctttaatctactttgagttgattttttatatggtgtgggggtacgggtgcagtttcatttttctgcgtgtgaatatccagttgtcccgacaccatttattgaagagattgtcttttctccattgtgcgttcttggcacctttttttgaaaatcagttgactgtaaatgtgtctgggctttctattccattccattggtctatgtgtctgttctgattccagcactctttatgctcttttgattgtaatagctttgtggtatattttaaggtcaggtagtttgatgtctacagcttttttctttctgctcaacattgctttgcctatttgggatcttttgtagttccatatgaattttagatagttttttctatttctgtggaaaatgtcactgaaattttgataaagattgtattaaatctgtaggtcactttgggccagaataaaaattttagcaatattaattatttcaatttataagccctagatttcaatttattaaccctagatttcaatttgtttgtgtttgttttcaatttatttcatcagtattttatagtttccagtgcacaaatctttcatgtccttgattaaacttatttctaagtatttttttatagctagtataaatggcattgttttcttaatttcttttttcaggaggttctctgttagcatatagaaatgctactaatttttgtatgtggattttgtatgctgaaacttcactgaatttgtttaatagttctaacaggtttttggtggactttttgagttttccatatataagatcatgctgtttgtaaacacggctaatttaacttctttctttccaacttgaatgccttttattttcttttgcctaattgctctggctagaactttcagtgttatattgaataaaagtgacaagagtggtcattgttgtattgttcctgatcttagacgacaatttttcaactgtgttgaatattatgtttgccatgggtttgtcatatatggcttttattgtgtttaggtactttttttctatacctactttgttgagagtttttatcatgaaagcatgttgaatttcatcaaatgccttttctgcatctgttgagatgatcatatgatttttatctttcattctgtcaacatggtgtgttacatttataggactgggtattttcatccatcttcatattccaggggatacatctccattgatcatggtgaatgatacttttaatatgctgttgaacttggtatgctagcattttgttgagaagttttacaaatatgttaattaagtgtattggcctgtaattttcttttcttgtattttcgcctggctttgatatcaggataatgctggccttttaaaatgagtttggaaatgctcccttttcttgaatttttgttgttgttgttgctgctgtttgagacagagtttcactctgccaccgaggctggagtgcagtggtgtgatcttgactcactacaacctccaccttctgggttcaagtgattctccttcctcagcctcctgagtagctaggattacaggtgtgcaccaccatgcccagctaatttttgtatttttagtagagatgggatttcaccatgttggccaggctggtttagaactcatgtcctcaggtgatccgccattcttggcctcccaaagtgctgggattacaggcgtgagccatcccgcccagtcttcttgaatattttgaaagagtgagaaagattggtattagttctttcaatgttggtggatttttgtaaagaagctttcagtccctgagcttttctttatgagtgacttttcttgttggttcaatcttcttacccattattggtctgttcagatttttatttattcataattcagtctttataggtggtatgtgtctagaaatttatgtatttcttctatgttattcaattcttggtgtataattattcataatattcttttataatcctttgtatctctgtggtattgcttgaaatgtctcttctttcatttctgattacatttatttgagtcttctctctttcttagtctagttaaaggcttgccagttttatcttttcaaaaatccaactcttagttttattaatcttttctattgtttttctagtctctacctcatatatttctctctgatctttattatttctttctttctactgattttttcttttagtttgttctttttctagttgtttgaagtgtaatcttgggtgatttattcagtctttcttcttttttgatgtagatgtttattgctataaactttcctctcagaactactttttctgcattctataagtttcattatattgtgtatccattttcacttatatcaagatattttttatttttttctttgacccattggttggtctgaattatgttgtttaattttcatgtagcacattaaatttaattgataaatgactattcagagatgttttccttatgtcagctgctattttataagtttcaaggagttcttccatttcatccaattttcacatttatttgcatgatattttttattatattttcttatttattaacaatttttcataatgttccctttttatcctaatttgataacattggatatagctgccaattgcttctttatacagttcatgcagctactgccaagctatttgagtttgccttgtcatagagtattactcgccactccagtgtagttaaaaaaaaaaaaaaagcccactgaactaggtatctaaaaacatgggataaaataaggctttgacagatcataattttgaacttattatgtaaattttgtagacctttgtttccttacctgtagaatgaaaataatcgtggctatgtggtttagaaaactgtcttaatctattggggctgctatagcaaatactttagattgggtggcttataaacaacagaaatttacttctcacatttccggaggctgagaagtcaaggtgctatcagaattggtgtctgccgaggttttattccctactttatcgatggtgcctttttgttgtttcctctcatgatggaaggggcaaacaagctctcttaaggttcctttataagggcacaaatcacattcatgaggattctgccatcataacctaatcacctcctaaatgacccacctgttaattaattgcagtggtgattaggtttcaatgtatgaattttgtggggacacgaactttcagaccatagcaagaaccaaataagagtagaagggcatgctaaataatgaagagagttatgagtaaaggatcctggttacaagtcctggatctcacccttataaactagagcttggacaagttggtaaatatcatgaagacagcatctgcatatattttgtttttctctctatccacagaatagcacctatatagtaagtatgcaaatggtaattattgaattaaatgctttgccaaataaggggattttagaagattatacgtaatgtctctttaagttatatattctgtaattctaggtaatatatgtaaaagtgctttgaagattgaacagtacaattgtaagaaattatttttaaaatcctggttacataattgtaaagctgctaaagcagaagtaagacatttttgatattattgccagataactggtggcaggcttggattcttcaatagggagtagacagagtatggactataaagttctgctggactaaatgataattattacatatcaatattagatgggccactggcatcccctgagttttcagtttattctataagtgcttgcataatacttttaagatatacttggcacctgtatctaacaattataatacattgagcctttcctcccaatttccttttgaatattagtaaggctatatagttggctcctacctagtaagaaatactcccttgctgctacatttttgaaatggtgtggccaaaattggtatccagtaaacaaacacttatttatataccactgagtgtgggtaataatgagcttaaataatgcatgtatgtgggtcatttgttctagaacattgtggttttaaacctattgcagatagaccaagttaattctcaggcttctttattttctaaaacgtcagaccagtaaatagaatattttatgacatgtaagttctgctgtcattttggatcttaaatctacatcttaaaaaatgatatagcataataatgatagtggtaacctgaagcaatttttaaagcttgttttctgttaatgggggacattacctattttctttttgactgtgaaagattcaggtcagcaaagatctagcaaaatgcatgtcattgcagatttccttcattgtcacctgttgcttgggcatcgtcacatgtgaaagagaaaatgatttcttcttttctcttttctttgtttcctgtctttttaaatgttctgactgcctggtgtgtgtccaggacaaaatgttttttgtggggtgtgtgtgtgtgtgtgtgtgtgtgtgtgtgtgtttgtgtgtgtgtggcagggggaggggagtggggaggcatgtataagaggcacaaagaagagataaaatcaaaaagtacataatatgtcttttactttcctcaggcaaaaattgtttttctatttggtcttagttcggcttagtgttaactgccagctctaagtcatgccttcctttggaagacattttcaatcagaatgtacgctagaacatcctgttagactgttctgattttatggactaatgtcttctgtctttctgtcttcaggagtttctgggcttgtagacttttggacacgtggaaactgttatatgcaaaaccacaggtgcttctatctatgtgttcagtttttattcctgcatacaactgtacaataaatataatctttgttctttagaaaacaacaattgttcttttgcagtttgaactttgagcctcacattttgatagaatattagagtggtaatgacttccaagataatttgtgtagcactttgcttttacagatcagagaatttgggatgatagcaagtgaatgattgttaaagatcccactgctctttgtcagatgagtaggttgcgaaaattttctcccattttgtaggttgcctgttcactctgatggtagtttcttttgctgtgcaggagccctttagtttaattagatcccatttgtcaattttggctttggttgccattgcttttggtgttttagacatgaagtccttgcccacgcctatgtcctgaatggtaatgcctaggttttcttctagggtttttatggttttaggtctaacatttaagtctttaatccatcttgaaatgatttttgtataaggtgtaaggaagggatccagtttcagctttctacatatggctagccagttttcccagcaccatttattaaatagggaatcctttccccatttcttgtttttctcaggtttgtcaaagatcagatagttgtagatatgcggcgttatttctgagggctctgttctgttccattgatccatatctctgttttggtaccagtaccatgctgttttggttactgtagccttgtagtatagtttgaagtcaggtagcgtgatgcctctagctttgttcttttggcttaggattgacttggcaatgcgggctattttttggttccatgtgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggcgttcactcatgatttggctctctgtttgtctgtttttggtgtataagaatgcatgtgatttttgtacattgattttgtatcctgagattttgctgaagttgcttatcagcttaaggagattttgggctgagacaatggggttttctagatatacaatcatgtcatctgcaaacagggacaatttgacttcctcttttcctaattgaataccctttatttccttgtccttcctaattgccctggccagaacttccaacactatgttgaataggagtggtgagacagggcatccctgtcttgtgcccattttcaaagggaatgcttccagtttctgcccattcagtatgatattggctgttggtttgtcatggatagctcttattattttgagatacgtcccatcaatacctaatttatggagagtttttagcatgaagcgttgttgaattttgtcaaaggccttttctgcatctattgagataatcatgtggtttttgtctttggttctgtttatatgctggattacatttattgatttgtgtatattgaaccagccttgcatcccagagatgaagcccacttgatcatggtggataagctttttgatgtgctgctggattcggtttgccagtgttttattgaggatttttgcatcgatgttcatcaaggatactggtctaaaattctcttttttggttgtatcactgcctggctttggtatcaggatgatgctggcctcataaaatgagttagggaggattccctctttttctattgattggaatagtttcagaaggaatggtaccagttcctccttatacctctggtagaattcggctgtgaatccatctggtcctggactctttttggttagtaagctattgattattgccacaatttcagctcctgttattggtctattcagagattcaacttcttcctggtttgatgcagccatcccattactgagtatatacccaaaggactgtaaatcatgctgctataaagacacatgcacacgtatgtttattgcggcataattcacagtagcaaagacttggaaccaacccaaatgtccaacaatgatagactggattaagaaaatgtggcacatatacaccatggaatactatgcagccttaaaaaatgatgagttcatgtcctttatagggacatggatgaaattggaatcatcattctcagtaaactatcgcaagaacaaaaaaccgaacaccacatattctcactcgtaggtgggaattgaacaatgagaacacatggacacaggaaggggaacatcacactctggggactgttgtggggtggggggaggggggagggataggattgggagatatacctaatgctagatgacgagtaagtgggtgcagcgcaccagcatggcacatgtatacatatgtaactaacctccacattgtgcacatgtaccctaaaactttaagtataataataataaataaaataaaataaaaaaggaaaaagaaaaaaaaaaaagaaagatcccactgctttggtagtgacaagacccctatgaaatactaggtgtagaatttcatggcccattccgtttttctgctgtaccacacacagcctcataacatttcaataaccatcttcagaaatgagccttatgtcatcctctccctgtcagcccccacatgatatcgtagcatgaaggtttcctgagtttggtagtctgaaacaatctctcttctccctccatgatgcagtggaaagagcatggaattggaataattcactcaactatatttattgaatgccttctctatgccaagaatgtgaccaggacctaggaatacaaaagtgagtgaaggacgttatcctggtttttacagtctatttggacttgaatcttgcaacttatcacttgtatatctcagacaaatcattttgcctctctgataccccattctctgatctttaaaataagggtaaattcaattttttaaagtcctaagaattaattaatgtataaaaatgtaaatcttctggcacatttctgacaaacagcaggcattcgctcaataaacgttaatatcttccctctaacttctaaggattattgtgaaaatcaagtaagataatggatataaaattgtgttgtgaattggaagcatatgttatagttacagatgaagttggagttttagagggtctacaactttcctcacctttcaagttcaattctaatgagaagaggaagacacctcaggattaaagtagctatttagttactgataaaagctggtttagaagttgattttgatgtgcttcccattcctttacttcagagtgcaacttccctgctcaggcacaggcatactggaatagctacaagttttacccactggaacaggtaatttatttcaaggcagagagcaaagagaataaatgttttctgcagggaagtggagaagctgtgaaggggtagagctacccatggctaattctgttttcaaactcacctatcaagtaaattgcttgacctcatgtggaagagaaactgcaaatgctaatttttgaaaacttctctgcatggaaaggaaatagaaggccaaaaaaatatatgtttctccaacagatacatacatattcctgtgaaaaaacctcaaatcagcctccttcctccaacttctcattcttttttttttaacttctattttaaattcagggttacatgtgcaggtttgttacatagggaaacttgtgttatggagattagttgtacagataatttcatcccccatgtataaggcctagcacccattagttatttttcctgatcctctccctcctcccatcctccaccctctgataatcctcagtatgtattgttcccctttatgtgttcatgtgttctcatcatttagctgtcaattgtgagtgagaacatgtgatttttggttttctgttcttgtattagtttgctaaggagactccagctccactaatgtccctgcaaaggacctgatctcattctttttaatggctgcatagtattcccctgtgtgcatttgccacattttctttattgagtctatcattgatggatatttaggttgattccatgtctttgctattatgaatactgctgcaattaacatacctgtgcatgaatcttcataagagaacaattatattcctttgggtatatacccggtaatgggattgctgggttgaatggtagttctgtctttaggtctttgaagaatcaccacactgtcttccacaatggttgaactaatttacattcccaccaacaatgtgtaagtgttcttttttttctccacaaccttgccagcatgttattttttgactttttgatagtacccactgtgactggtgtgagatggtatatctcattgtggttttcatttgcatttctctcagtgatgttgagcttttttttcatacgattgttggctgcatgcatgtcttcttttgaaaagtgtctgtttatgtcctttgcccactttttaacggtgttattttttttccttataacttttttttttaagttccttatagatgctggatattagaccattggatgcatagtttgcaaaaattctttaggttgtctttttactctgttgataatttcttttgctgtgcagaagctctttaattagatcccatttgtcaatttttttttttttttgagacagagtctcgctctgtcatcaggctggagtgcagtgtcatgatcttggctcactgcaacctccgcctcccatgttcaagcaattctcctgcctcagtctcctgagtaggtagaactacaggcgcacgccaccatacccagctaatgtttgtatttttagtagagacggggtttcaccatattggctaggatggtcttcatctcttgaccttgtgatccacccgctttggactgccaaagtgctgggattacaggtgtgagccaccatgcctggcccccatttgtcagtttttgcttttgttgcaattgctttcagtatatttgtcatcaaatctttgcttgtgcttgtgcctaggttgtcttccagggtttttatagttataggttttacatttaagtctttaattcaccttgagttaacttgtatatatggtgtaagaaaggggtccagttttaatcttctgcatttggctaaccagttatcccagcaccatttattgaataagtaatcctttccccattgctggtttttgtcaggtttgtcaaagctcagatagttatgggtgttcaatcttattttttggttctctattctgttccaatgacctatgtgtctgtttttttctatcaataccatgctgttttgattactgtagtcctgtagtatggtttgaagttgggtagcatgatgcctttagctttgttctttatgcttaggattggctattctggctctttttttttgttccatatgaatttaaaatttttttttctagttctgtgaagaatcttgatggtagttttatagacatagcattgaaactataaattgctttggacagtatggccgttttaatgatgttgattcttcctatccatgagcatggaatgtttttacatttgtttgtgtcatctctgatttctttgagcagtggtttgtaattcttcttgtagagatctttcacctccctagttagctatatttttaggtattttattctttttgcagcagttgttaatgggagtttgatcctgatttggctcttggcttgactgttgttggtgtatagggctagtgatttttgcacattgattttgtatcctgagacattgctgaagttgtttatcagcttaagtagcttttgggctaggactatagggttttctacataaaggatcatgtcggctgcaaacagggataatttcatttctggtctttctgtttggatgccttttatttctttagcttgcttgattgccctggatagaacttacaatagtattagaacaggagtggtgagagaaagcagccttctcttgtgccaattttcaaggggaaggcttccagcttttgcccattcaatatgatgttgactgtgcatttgttgtagatagctcttactgttttgaagtatgatcattcaatacctagtttattgaatgtttttaacacaaatggatgttgaattttattgaaagccttttttgcacctattgagataatcatgtggtttttccctttagttctgtttatgtgatgattcacattaattgatttgcatatgttgaaccaaccttgcatccccgggatgaagcctactcgatcatggtggataaactttttgatgtgctgctggatttggtttgccagtattttgttgaggatttttgcatctatgttcatctaggatattggcctaaagttttcttttctttggttgtatctatgccaggtttttgtatcaggatgatgctggcctcatagaataagttagggagaagtccctcctcctcaattttttggaatagttttcagtcagaatggtatcagcttttctttgtacatctgataaaattcagctgtgaatctgtctggtcctgaggtttttttggtcggtaggctgtttattattacagcaatttcagagcttgttactggtctattcagggattcagtttcttcctaatttagtcttaggagggtgtatgtgtccagtaatttatccatttcctttaggttttctagtttatatgcatactgatatttataatattctctgatggttgtttgtatttctgtggcgtcagaagcaatatccctcttgtttctgattgtgtttttctgaatcttctcttttttcttctttattagtataggaagcagtctatctatcttattagttttttcaaaaaactagctcctggattcgttgatcttttaagtggttttttttgtgtgtctcaatttcctttagttcagctctgattttggttatttcttgtcttctgctaacttagggatttgtttgttcttggttctctagttcttttggttataatgttaggttgttaatttgagatctttctaactttttgatgtggtcatttagtgcagtgccataaatttccctcttaaccctgcctgtattagtccattttcatgttgctgagaaagacatacctaagactgggtaatttataaagaaaaagaggtttaagggactcacaattctgtgtggctggggaggcttcacaatcatggtggaaggtgaaaggcatgtcttatatggtggcaggcaagagagaatgagaaccaagtgaaagtggtttccccttataaaagcttcagatcttgtgagacttattcactaccttgagaatagtatgggggaactgcccctatgattcaattatctcccaccagttacctctcacaacacttgggaattataggagctacaattcaagatgagatttgggtggggacacagtcaaactgtatcattctttccctgactcctcccaaatctcatgtcctcacatttcaaaaccagtcatgccttctcaacagtcccccaaagtcttagctcatttcagcattaactcaaaagttcactgtccaaagtctcatctgagacaaggcaagtcccttcggcctatgagcctttaaaatcaaaagcaagttagttacttcctagatataattggagtacaggcaatgggtaaatacagccattccaaattggagaaactggccaaaactaaggggccacaggccctatgcaattccaaaatccagcagggcaatcaaatcttaaaactccaaaataattttcttttaccccatgtctcacattcaggttatgcagatgcaagtggtgggttcccacggtcttggtctgctctgcccctgtggctttgcagggtacagcccctctcctggccactttcacaggctggtgttgagtgtccatggcttttccaggtgtgcggcgcaagctatcagtggatttaccattctggggtctggaggatgatggccctcttctcacaacttcattaggcagtgccccagcgggaactctgtgtaggggcttcaactgcacacttccattctgcactgccctaggagaggttctccatgaggccctgcccctacagcaaactcctgcctggacatctaggcatttccatacatcctctgaaatcaaggcaaaggttcccaaacctcagttgttgacttctgtgcacctgcatattcaacaccacatggaagctgccaaggcttggggcttgcaccctctgaagccatggcctgagctgtactttggtccattttagtcatggctagggcatctcagatgcagggcatccagcccctaggcttcacacatcagggggacctgggcctggcccaagaaaccattttttcctcctaggcctccaggcctgtgatgggaggaattgcagtgaaggtttctgacatgccctggagatattttccccattgtcttggtgattaacatttggctcctcgatacttatatgggtaataaggaactggcttgaatttctcctcagaaaatagttttttcctttttgttgcattgtcaggctgcaaattttttgaacctttatgttctgcttcccctttaaacttaagttccaattccaaaccatatctttgtgaatgaataaaactggatgcttttaataatacggaagtcacctcttgaacgttttgctgcttagaaatttcttccaccagatggcctaaatcatctctctcaagttcaaagttctataaatatctagggcaggggaaaaatgctgcaagtctctttgctgaaacatagcaagagtcacctttactctagttcccaacaagttttcaatctccatctgagactacctcaacctggacttcattgtccatatgagcattttggtcaaaaccattcaacaagcctcaaattccaaacattcccacattctataattcaaaatgagatttggacggggacacagccaaatgctatcactgctttttctgtgttccagagattctggtatgttgtatctttgttctcattagtttgaaagaacatattgttttctgtcttaatttcattatttacccaaaagttattcaggaattggaaaggaaaaattatattaaaatattcactctaatcacttttgggtatgatttccagtgattattattatcatgttttttgtacattttagaatttattaataatgtgttttttaaaaactcaaccccctctcccgctgccaaaaaacaaaacccaaatactaaaaatgggcacaaacaaaagcctaacctagccaaaagtttcttcttctctaattctgacaaagttttctaatgtcttcttttcagttacattcagtatgagtgatccaagagactcacttcatgccttgaacattaatggaagggcgaattacaaatattatatgtgaccctaaaaccccatcttttccattatttgtgaataatgataagccctggaagtaaggtgaaaagttctaacatcttttccttcattagtgtcttttcacttgtttaaaagccatctgtagttatgattctgtcaaatgtatgttcattgtctttgcctgtgttttctgttttttgacattattgttaacatgtaaaagctttttgtatattagaaaaatgactttattttctgtaatgtgaattacaaatatcttctcacttcttgattttgttgatagtcttgatagaacatttttggaaatagagactttatttttaaaattaggttcaatttatttatcttttctttgaacttctttgttttttatactgagaaaggcctccacttccaggttataaaagttttctgcattttttcttctgagctattatggttttatttttacatttaaatatttatattttagaatgtttactggtgtaaaggttgaggtgtgagaaattattttcccccagatgactctccagtcttataataccatttatggaataatccgtgattgcctcatctttatcatattctaagtttctacatgcatttgcatttatttcttggcttctaatttgtgtcaagattccatttattttttcagagagcaccacattttaaaattaggttgctatgttatgtattttaaaatatggttagtaaaataccatctctttgttcccataatacagcataaaagtgaactcaggaggtggttctctgttggagagattacacatatatttatcattttttattacaataacttcagtttttttaaatcaatatcacagcttttgctattttggaagggtgcctcttgaaatgacatttaggcaagcctatgattcaattggtgtctcaactattagcattctaggatgcagttgtatttcaaggaggaataatctgggactggcaatttcactataaaaaactggttatcataggcaagcagtgtagcacaaggcatttaggagaaacatatatctttgttctgtatgttttgctgagacatcttcccagtatctctttggactgagaaatatgctgttttctcaaatagaaaaacctagtgattgtgccatcttagacatttggaatgacatgccaactttgtgtgtgtaggtgtattgtgccaggtactcaaaatagattatttcaaatactcgaggggctcaaaaaatctatttgacaagataaataattaacatttctgattccttttactgaattcaagaaataactccaatctaatttgtgatatgacaatatttttggtccattgctaatttttagcagtatttatatagcttttcaaagagtgctgtaactacggctagaaaaaatatctctgaaaagtaagcacctagagtatgtatgtgctttctgcctttagttcatatgattcaccccgacttaatttatctttgggaatttattcccaggaaataatgcaaactatagaaaaaaatgtatatatgcaatttttattgtcatactacttaagaattaactaaattgaaaataactgaaatgctcccatttaggggaatttttatataacatagtatttacaggtatggaacatttgtcttaaaataatgcttacaaggaggttttatggtgtgggattatgctgttgatgaaaagtcaggtattaaaaactaaggctatggagggtagtctcagctattaacattacattgtactgtaaaaatgttagaaggggttctctgagagctgggattatgggtagttgcttattaggcttctctaatctttgtggcttttgtgaattttttacaaagtatgcaaaaatgcaattgcttttaaaatatgtttacaacactttctcttgactttaatctagcatttctaatatcatccattaattttctttaatatatctttttactgaggtacaagttgaatataaaaatataaataagtgaaaattattaagatattttatatggataaacatctatgtaactactattcagattagtataatagaacatttccactgccccataatgctctctcatgcctcattccaatcaatactgctatatgtaactaaccactattttaacttaatttctctacaattcatgattgatcatatatgcatatttgaacttcatataaattgaaaaatgtaatatgtattcttttgtatcttggtttttcattaaacattatgttttaaagagccatctttactgttgcatgtaataacagctttttcattttaattgttgtgcatgctctatattaataaacacatattttcagtagatcaaaatgctttctcaaagtggctgtaccaatttctattttcatcagcaatgtataagagttctagttggtccacttccttgagttctagttgttccacttttatcacatctttggcattgttggctgttttaagtttagccattctatgtaagagatacaatggattgggagaaacagcagttgagaagttgtatccaaggaatctcatctacttaatattttctcttagatcactgatgctaatttttttactatatcttcttcaatttgagtaagtcctattaatttcttcttgtcattggttattacttttacagattatgttttgttaagatcctccaatgaattttttacatcatgcattgcaattttcagttctataatttccatttgctctttaagaatatttattactctcctgaaatatgccatggcctcattcattatatatgtcttttcctataaacatacttataatagtttttttaaagcctttgattactaattttcataactgtgtcatctctgtgtttgcttttattgactctcttttatcttgattataggtcatatctgggctattcttcattttcttaatatgctagtcttgatactatgtacaaatgaatgcagagattaaagtatgaattttgttctctttatttctcagagagtacaaaacctcttttctgttgggtggttaggatgaggggctgatcactcatatttcttttagagttaaattgatttggagctgagatgtaatttcaaatagatttacttcagttacgattggcccaaatcccaaattcctgtcactgtctttttactcttgtcaatatttagctcaaatatgttgggatgtactttcaagtgtttgggttcatatttgtagtcaactctagtaacatcttaaaagtcaagcaccacaaaatttttgcattataaagtaaattctctctcaattttaatccatttctaatgtcacattcttgtattatgtctagataagatcaacattgcagctggagagagaactttcaacctgaataatgtgtttttgtgtttgagcctcttcctaattcctaacagtggtttatttcatgaacccactctttttttctaaagcttgcctgatttctcattgtctctccaaagactgaagttctgctccatgctatacctctacacagctcaggcacaaacctctagatatgaaagttctctgctctctctaatcgtatttaaagggcttgttttattggattagtattttcatgttatatactttctcatgctttacctttcaacctttctttaccactatattttagaagtgcttcctttaaactgcatgtaatcgagttttaaaaatctagtctgacatcttttgttcattaacctgaacatttaatccattacaattaatgtatgtgcagatccatttgggttgaaattgtcttattttatcttttctaattgtcctgcctgtatggtgtttattttttagttctttcatgcctttttttgtattgagtgtgtatactatttatttatatcttttcaagtatggcatttatcattctatttttattcatttagtggttaataacccttataaaataataacatatttttcttctactggataataaaaatacataggtatgtaagtccattcaccccttcctctttcagtttttatgccattattttcctaacaccacaaggtacttttctttggatttgctttaataaatatattagttcttagggctgctgtaagaaagtaccacaaactggatggcttaagatgaaagaaatttattatttcatagttctagaagctagaaatctgaaattaagatgttattagggccatgttctctctgaagcctctatgggaggattttttcttgcctcttgtagcttctggtatccccaggcatttcttggcttgtggtggcagagctccaatatttgcctccaacttcacatagctgtctttcttctgtttgtgtgaatctatctctttgtgtctcctcttttcctataaggatttcggtcatattggattaggggcccactcttctccagcattacctaatctcaattaattacattggtcatgaccttatttccaaataaggtaacatttgaggtactgtggggttagttctccaacatatgttttgagggaacacaattcaatataacaatgaattaatgtttatttagatttacctatatgtttaatatttatgttgatttttattttttcttacatctcctaacttctacctgggatcattttcttctgattggagtacacctttaaatatggatatgctggttgaaaactctcatttttgtccacaattgtttgtatttcatttatattcttgaatactgttttttctgtgtatggaatacaagcttgtcagatatgtcttttagaatattgatgatattgttcaactacctcctggtctccattgttgtgattgagaaattaactgttaattggaaactctttgggcgattttattttttctggcttcttttaagactatgcctttatttctttctcctgcctgatcttccttacaccttatacaaaaattaattcaagatggattaaagacttcaatgtcagacctaaaaccgtaaaaaccctagaagaaaacctaggcaataccattcagggcataggcaagggcaaggacttcatgactaaaacaccaaaagcaatggcaacaaaagccagaattgacaaatgggatctaattaaactaaagagcttctgcacagcaaaagaaactaccatcagaatgaacaggcaacctacagaatgggagaaaatttttacaatctacccatctgacaaagggctaatatccagaatctacaaagaactcaaacaaatttacaagaaaaaaatcaaacaaccccatcaaaaagtgggccgaggatatgaacagacacttctcaaaagaagacatttatgcagccaacagacacatgaaaaaatgctcatcatcactggccatcagagaaatgcaaatcaaaaccgcaatgagataccatctcacaccagttagaatggcgatcattaagaagtcaggaaacaacaggtaatggagaggatgtggagaaataggaacacttttacactgttggtgggactgtaaactagttcaaccattgtggaagacagtgtggaaattcctcaaggatctagaactagaaataccatttgacccagccatcccattactgggtatatacccaaaggagtataaatcatgctgctatgaagaaatatacacacgtatgtttattgcggcactcttcacaatagcaaagacttggaaccaacccaaatgtccatcagtgatagactggattaagaaaatgtggcacatatacaccatggaatactatgaagccataaaaaaggatgagttcctgtcctttgtagggacatggatgaagctggaaaccatcattctcagcaaactatatcaaggacagaaaaccaaacactgtatgttctcactcataagtgggaattgaacaatgagaacacctggacacagggtggggaacatcacacactggggcctgtcgtgggatggggaagggatagcattaggagatatacctaatgtaaattacgagttaatgggtgtagcacaccaacatggcacatgtatacatatgtaacaaggctgcacatcgtgcacatgtaccctagaacttaaagtataataaaaaatatttattttaaaaaaagactacgcctttgactttggtttttggcagtcttgctttgatgttcctgtatatggatttttagtgtatgtatgtatgtatatatgtattaattgtttattcattcatttgtgtgtttcagatcctttggggtccttgaacctgtagactgctgcttttcatgagtggcatatttatgaggaaattctctaaaatcaaaacagtgagaaatgtggggttgtgggggatatagttgggagataattttccttgggtctctcatgtttctatttctgcacatatataacagtttttgtttcaaactatcttggaatacagatttgaaaaatagtacctatctgggtggaaggcagatttttttgctatccaaaataataaatgtaatgttcccctttgatgcaaaagtggggtagttttgttagcaatctccttatgagatgggatttcctgaaatcatggttccttagctgtgacataaaacctactatatgtgcaacatctaccagagctcacctttgaatcatcttttgggacttggggtcaaaaagaagttatgtaaacaggaaggtcatgctgcctgcagtgtggtaagaaagtgttttatgacacagaggtatatgtcttctttcgacatctaggaaactgtggaaggataacttcttaggttataaaaaggataaaatctcagacccttcatagttgcttaaaataatgtcttttttcggccagatgcggtggctcatgcctgtaatcccagcactttgggaggccgaggcaggtcatcacctgaggtcaggagttcgagaccagcctggccaatatggtgaaatcctgtctctactaaaaatataaaaattagccaggtgtggtggtgggtgcctgtaattccagctacttgggaggctgaggcaggagaattgctttaacccaggaggcagaggttgcagtgagctgacacggtgccactgcactccagccaggatgacagagtgagactctgtctcaaaaaaataaataaataataaataataatgtctttttattggcagctgtataaaacaccatttttcagtatttagattatgtcttggtgtgccttgatatttattctgctttttttgatgtttagtggaattataattctatcaaatatgaaaaatttcatctcattatttcctcaatatttttctcctccctcattctgttatccaataatacttttgttggatcatttgatattgtcctaaaagttgattacactccttatttttaaaattcctgttttctttttgtatttcattttgaatagtttcaattgtcatgtcttcaatttcaatgatctttacttccgcagtgtctaatttgatgtaatcctttccagagcattttttatatttagacaattttttttctcatttttagaaatttcatttgggttgttttatctcttaaatttgtttcttctttatgtttacttgtttttctttatagccttgaaggcacaggcagtccctgactatgatggttcaacttatgatttttcaacttcacaatcacatgaaagtgatatgaattcagtagtatctcattaaattacatgaattacatgactcaacactttattataatattggcttcatggtaggttattttgcccactgtaggctaatgtgagtgttctaagcatgtttctggtaggctaggccaaacaatgtttggtagctcagatgtattcaatgcattttgacttatcatacattcaaattacaaagggtttgttttggacgtaaccccatcgtacgtgaagacacatttgtatttatagtatttgcaaaaccttttttaaggtttttgtctgctaattccagcatctcttgttttcgagtctatcattgatttttctccaggttatttgtcatgcatttctgcctccttgcatacctgataatttgtattggaagccagccaatgtgaattttatgttgttcagtgttggatttgaatgtgttaatttaaagagttggtattttttctggcagtcagttaagatacttgtagatcagtttgatacttttgaggtttcctcttaagctttattaacatgagtgttgagcaagctttattgtaggactaatttagtcccctctttctcactaagtaatgactcacttttgaatgactccatcatatgcctcaaatattgtgagactcttcattctggctggtgggtatgttaactatgctaggcatgtgagatcccaaaatatcttgtttgtttttatgtagggagagcaaaagttttacgattaaaatagaagggctgatgtttttgactatgtgctgatccttgaatttaaaaaattgtttctatgtaatatttgaaggctaggatgataatatttttctgcaaagggaatttcacattcttctgctaggaacctgggggtattgtcattctgagaccaagttcaatgtttgaggttctatggattatcagatttagaaatatggactatttatatctgatttacctttgatttatttttaccttttgaaatctgggcttattatttgtgtgtaaaggtgattttcagactgtctgacttcattgggctttgacttttatgtccaatttttatgaagctaccaaaaacggaatttcagatttgtagttcttcttgattggcaaagaagagagacacttgaatgctaatatcttcactcaggtatttctggtgctacagctgctggtacagtgtgtagaaccaccaccataagccttttgtcacttaatacatttaaaaatagactttatttttaagagcagttttaggctcccagcaaaacacagagaaaatatggagaattcccatatacccacctatacaactcacctgctctcagcatcttgtacaagtgtgctacttttgtcacagtgaataaacacattgacacatcattatcacccaaagttgatcgtttacatttgggattcactcttagcgttgttcattctgagttttgataaacatgtaatcacaggtatccactattaaagtatatggaaagtttcattgacttaaaaatcctctgcgctcaacctattcatctctccctgtcctctaactcctggaaaccactgaattttttactgtctccatggtttaaacttttccaatatgccatatagttagaatcatacagtatgaaacctttatacattggcatttttaacttagatgtatgcatttatttcctccatgtatttcatggcttggtagcatactttttaaagaaacaataaataagatcccattttctggatgcacacattttattatgcattaacttactgaaagacatcttggttgcttccaagttgtggcaaatatgagtaaagccatataaacatccatgagtagatttttttggagctatacttttcaacttatttaaataaataccaataagtataattacttatttgctacaaatatgtttaattttgtaataaactgccagactatctttgtaagtgattgtaccatttttgctttcccatcagcaatgaataagaattcctgttgcttcacatcctcaccagtacttagtgttgtcaaagttctggatcttgaccattctaatattcataggtatatagtggtatctcattgttgttttagtttgcaatcccctaatgccatatgatgtttaatatcttttcatatcatgacttgatgtctgtatatcttctttgattatacctacacctgttgctattattattttgaaccaactattatttattagatcaattgaaaacaggaaaaaatattttattttacctttgcttatttcttctctaatattcatccttcggatatgaacttcacatagatctgactttataacctatatcattttctttctctctgacacaattctttttaacatttcttgcaagataggtcaacaaatttcctgatttttaaaaagagttttccatttatttcttgtggtaaaatccacatgacataaaatttactgtcttaaatttttaagtgtacttaaaatgatactgatggtaattatgttcacattgttgggcaaccatcaccaccacttacctccagaattcttttaaacaaaatatttttgcaaacacaaatatgaaatggggaccaacatttatcttcaaaacattgagacctggtataggatacaacctccactgagactggcttatgcagctcttggatgatattggaggttgttaaatggtcttctaatatggatagaaaacagttttagcaggctcttgcatgatgttggaggttgttaaattctaatatggatgaaaaacagtcttagcagaagaatgatctcattcctggtgctgtttctcaaagagaggaattcagatgtgaattcctgaggctaggtagtttattctaaatataaatttattggcttatggctcgggagactgtgaagtccaagattgaggggccaccattttgtgaggtccttcttgctgtgtcataacatagtggaagggcaaagagagggcaagaggggggcaaacccattatcttgataatgaatccactcttgtgttagtccattcacaaggacagagtcctcatgacttaaacacatcttaaagattccatctcccaataccacaaccaatggcaattaaatttcaacatgaattttggacatgatatacatttaaaccataacatataccacaaaggtgagcccctgaaataaaagtggagaggagaccatcagcctatctcttctctttgaggagacgaggaatctcctaagaggaatctcagttgggggtttaaaggtggtctatgccttgtgaagataagaagagagctagagagaaacttggacagataacctcaatgcagggccacaaaacatgcataccctgcacaaaagtgcccgggttgtgaacatgaattggagatgaaattgtaccctagaaccatgcactctggcttgggtgtgattcattctggagaaagaagcatagcaacttttggaaactgatgtgcctagaaggggcacctctttgtaatttgttagcccggaggccacatatgcttacatgaggaaacctctttttcaatgcaaagagccactcataagcaagcaacagtagttccaactattaaaatgaagatttcatagctttaaagtgaaaataacctaaagcaatgattcacaattacactccgcgttttcctccctttgttaccctgcggtattcagtaaagaccctttatacatgacaacattgtctccattacagcatgcgctatctattcttagattaatgtgttaaagtgatatcagcacccatttctccaaaagataaacttggtagctagcagctgtaatcagcaaaaatccaccaagaaattgtgcccttggaattgtctataaaccacctgatccagtcacattcctggaactaaactggaaggtgtgggcaaaatggtgagcagatgaagtatgtgtagttttagaagggaattgtttacagcagctcaaagagaacttccagaggaagataaaaatatctcaacagaaaagaaaatttgaatatcatgaaaaacctaagaaaactctaaaactctttccagacagctcttttgactgaaaaaatatgaatatgttttgtaattattgcagaagtctatgtcataaagctacataaaattaaatcatgatttatcttacaaaatcttaatgttaactctaacctctttaaaggaagactttctttgttttacctaaaatattaaaaaattactgataaagaaaatgataatctgcatggtatacaagtatcactgacccccccccacaaataaaacagaaaatgaaaaattcccaagcattttaatagatacagtgcaaaaccaaattttctatatcttcaaatattactaactttacaggattagttattataatttgagtggatgctaatacataaagagtctgatttctaccaccaaatattttaatgaagttgttgatataattttcaaataaggagttttattatttcctattgctacctactcaaccttttgagagaaatattttctcattgtttatttgattaatattactggctagtgaaaatttacaacattttaaccatagtttccctgatgtgggtgaagacatagccctatagaaagggtagcaagaacacatgtattttgacacaaattctgtaagagaattttacaagggtaggactattaatatatctttagcaactttattagttttgaagtgctaaaatcatggatgtagagaactatatgagcaaataaaaatttgttcaaaagaaattttgttaaaattcagaattataaagtattgcactaacttactaatatccctacaatgtgatcttcctttcacctcacaaatgatatttgtgatgaaaagtttggtagtgataagaattataaagtaaaggtaagaaaggctaatgagatagataaatacatgcaggggtagtttttaggtggtcagggaagtaagtagtaagttgcctgtgagagctaaaatatgatggggaaggctcaagtcatgatgtgtacaagagcattccaggcagagaacctgcaagtgcagtgtctgaagctaaaatatgaagatattcttcaggagttttttgattagggaaagattgaaagatttgacaaaaatgaaaaagtccatttgttattctccatcaacagaaaaaatatgcatttttatatttctagtttaataaaatgtcttcatcaaaactaaaaccaaaataaactaggaattttcccatatatgtagaatgagaatttaggctattcacatttgtttctaagagatatttaccctatagtgagagcaatgattaacaacattatttccaattaattaaaataagttttggaaacattctacatattacattatattccaacagcccaacaggctagtattatcttcattcatagattaggaaaactgagtctcagaaaaaaatccataacttgtttaagatcagatgatcaaaaacattaaaatctagtcctgaacctgagtcttctgactcaaaatccaggaactttgtcatctgatgaaactaacactgaaacactactgaaagtagtttagtctacctttaatgtttcagatatccctagaaagatcatatatggatacttcagaatgtcacactttgtaaagcatagtggcaaggtttctgcatcttaaagaaggtggttgggaatatgtcattatctgctaagtatttctcatctatttatttaacaaatattttccttttttggcaaatataaattatacatatttaaggtgtacaacatgatgtttggatatacatacacattgtgaaatgactaccactatcacacaaattcacatatattcatcatctcacatagttactgtgtatgtgtgtatgtgttcagtgagaatacttaaaatttactctcagcaaattttgagtatacaatatatcattattaactagagtcaccatgatgtacattatatccctagaatttactcatcctttgtaattgaaactttgaattctttgaacaaacaacatatgtgtttcccacacctccaagaccctggcaatcaccattatagtctctgcttttacagatttgagtttttgagatttcatgtaaaagaacatacagtattcctgtttctgtgtgtggctaatttacttagcataataccttccaaacaaaattatgaatattgtgttgaatggcaggatttccttctttttaaagattgaataatgttctagcctctgtgtttctgtttgtgtatttatgtatgtatgcgtgtgtgtatgtatatatgtaaatgtatttattatattttctttatcaattcatcaggcaataaaaacttaggttgtttctatgtcttggttattgtgaataacatgacaatgagcatagaaatgcatgtatctctttgaggtcttgatttcatttcctttagctgtataaccagaagtgaaatcactggatcatattgtagttctatctttaattttctgagaaacttcaacactgttttccaaaatggctatactgatttacattcctaccaacaatgtacaagaattcactcttctgcacatccttgccagtacttgttctcttttctatttctggtaatagccgttctaacagatatgcagtgatattttattgtgtttttgatttgcattttcctggtggttagtgatgttgagtaccttctcatctacctgttggccatttgtatatcttcttttgaggaatgtctctacaatttcttctgctcattttaacatcaggtcatttgttttcttgctattaagttgtttgggttctttatatattttaaatataaatattaaccccttatcagatatatggtttgcaaatatattctcccattccataggttctctttactctgtggattgtttcctttgttgtacagaatctttttagtttgatgcactcccttggtctattttgtttttgttgcctgtgcttttgggatcatattcaaaaactcgttgctcagaccaacgtcaggaagcttttaccttatgttttcttctagtagttttacagtttcacgtcttacatttaagcgtttagtccattttgaatttatttttgtatatgctgtgagataagcatctaattttattcttttgcttgtggatatccagttttctccacataatatattgaagagactgtcctctttcccctttgtgtgttcttgccatttttatcaaagttcaattggccttaaaagtgtggatttatttctgggctttctgttttgtttcataagtttatgtgtctgtttttatgccagtgccatactgtttggattataataacattatattatattttgaaatcaggtagattaatgctttcagttatttttctcaaaattgttttgggtattcaaagtcttttatggtttcatatggattttaggatatttctatttccataaaaatgtcattagaattttatagaaattacattgaatctgaagaaggtcatatagatattttaacaatattaattttccaatctatgaacacaggatttttttcatgtgtttgggtctcttaaagttttcttcatcaatattttatagctttcagtgtacaaagcttttacctccttgtttaaattcatttcaaaatatttttgatgctgtatcattttattttttatttcttaattttttatttttaattttggtaggtatgtagtaggtatataaattcatgatgtacatgagatattttgatacaggcatacaattcataataatcacataaaggtgaatgaggtatccatcatctgaagcatgtatcctttctatgtgttacaaatactctaataaaactcttttagttattttaatgtgcacaataaattactgttcactgtagtcatcctgttgtgttatcaaatactagattttattcattcaatgtaactatgtttttgtatccattagccaaccctgtgtccatccctccagcccaactacccttcccgacctctggtaaccatcattctactttctctgtccatgggttcaattgttttattttttagctcccacaaataaaggagaacacgtgaagtttgtctttctgtgcctggcttatttcatttaacatagtgtcctgcatctattatgttgcaaatgacagaatctcattctttttttataagtgaatagtactccattaaatatgtaccatattttctttatccattcatctattgatagacacttaggttgttttcaaatcttggtgatacggtttggctgtgtctccacccaaatttcatctttaattgtagctcccataatttccatatgtcgtgggaggtaatttaatcatggggtggggctttcctctgctgttctcatgatagtgaataagtctcacaagatctgatgattttgtaaaggtgagttcccctacacaagctctcttgcctgctgccatgtaagatgtgccttttctcctcatatgccttccaccatgattgtgaggcctccccagccatgtggaactgtgagtccaataaacctctttttctttaataaattacccagttttgagtatatctttattagcagtgtgagaacagactaatactattggctattgtgaataatgctagagtaaacatgtgagtgcagacattacttcaatatagtgatttcctttcttgtaggcatatagttggtagtgggattgctggatcatatggtacttctattttcagtttttttgatgaacctccaaactgttctccatagcagttatattaatttacattcccaccaacagaggaccagagttccttttcctccacatccttgttagcatttgttattgtctgtcttttgtataaaagccattttaactggggtgagatgatatgtattgtagttttgatctacatttgtttgatggtcagtaatcttgagcacctttccaaatacgtgtttgccgtttgtctttttttgagaaatggcagaccttttgctcatcattttattagatttttttttgctgttgagttgtttgagctcctgaagtattctgtctattaatctcttgtcagatggatagtttgcaaatattttcttttttctttctttttttattttttgagacggagtctcactctgtcacccaggctggagtgcagtggcatgatctcagctcactacaagctccgcctcccgggttcacaccattctcctgcctcaccatccccagtagctgggactacaggtgcctgccaccaaccctggctaattttttgtatttgttttagtagagatggggtttcaccatgttagccaggatggtctcgatctcctgacctcgtgatctgcccacttcagcctcccaagtgctgggattacaggtgtgagccactgcacctggccaatattttttcttattctttcggctgtctcttcactttgttgattgtttcctttgctgtacggaagctttttaggttgatgtgatcccgtttgtccatttttcctttggttgcctgtgtttgtgggatattaatcgagaaatcattccacagaccaatgtcctggagagtttccccaatgtcttcttttagtagtttcaagtttgaggtcttagatttaagtctttaatctattttgatttgatgtttgtatatagcaagagagagagagggaaataggagtctagttttattcttctgcatatggatatcattttttccttgcctatacataggcaagaaaaaaatacgtatatttgttgtttgttttttgatttgaggttaccacaaatcttgcaagtatcttgtaatccattattttaaagtgatgacaatttaatacagatatcataaacagactagtaagggaaaagaaaactaataaaaactctacactttaatgctattttagattgacaagttttcttaatttctttttcagaaacttcatcgttagtgtatagaaatacactgatttttatacattgattctgtatcctgcaattttactgaattattttttagttctaacagtttttttggtcgagtctttagcttatcttaatatataagatcatgtgatctgcaaacagagaaaattttacttcttccttttttatttggatgccttttaactatttcttgactaattgctctggctggccattccagtactatgttaaatagaagtggtgaaagtgggtatccttgtcttgttcatgattttagggaaaaagctttcagcccttcatcattgagtattatgttaactgttggcatgtcatatttggtcttttttatattgagataaaacacttgtatactgatttgttgagcatttttttttatcatgaaatgatgttgaatttttaaacatgctttttctgcatttattataatgtcttatgcattttaccctttattctgttaacatggtgtatcatgtttatagatttgcatatttataaaccattcttttacctcagggataagtcccacttgatcgtgtcatataaacttgaatgggctgctggattcagtttgctagtattttgttgaagacttttaaatctgtgttcctcagggattggcctatacttttcttttcttgtagtgtccttgtctggctttggtatcaaggtaatgctggtatattagtcagggttctctagagggacagaactaataggatatatataagtttattaaggaactcacatgatcacaaggtctcacaataggccatttgcaagctggggagaaggaagccagtttgagtttcaaaactgaagaactcggagtttgatgtttgagggcaggaagcatccagcatgggagaaaaatgtaggctgggaggctaagccagtctagccttttcatgtttttctgcctcctttatatcctggccacactggcagctgattagatggtacccacccagattaagggtgggtctgcctttcccagcccactaactcaaatgttgattattttggcaacaccctcagagaaacagccaggatcaatactttgcatccttcagtccaatcgagttgacactcagtattaaccatcacagctggtttcataaaatgagccttgaagtatttcatcctcttcaaagagactgagaaggaatggtattaactcttctttaaatatttggtggaatttgacagttatcgtattgctgcctattgctcatttcaattctgtttatttttgctttatatatatatgttccaatgttgagtccctatatatttacaactgttagatcctcctgatgaatttacactctttatcatgaccttttgtgaccttttgtcttgtgaaatgttttgacccagtctattgtgtgttatataagtttagcctcccctgctctctttcatttgtatgagatatctctttccatccctttatttttagcctatgtgtctttttacaggtaaagtgagtctcttgttggcaacagatagttgtgccttcttttaaaaattcatttagctactctatgtcttttgattggataatttaatctatttatatttaaaatgattattaattgatcagaacctactattgccactacaactgttttcttaccattttataatttctctgtttctttctttgtttcttgctatcttctctggtgatttgataattttttattagcatggttttattcctgttttacgtatccactagagtttttttttattataaggtttacataagacattttgtaattataacagtttattataagctagtcacaatttaactgtaatgaaatacaaaagctctacccttttacttctcctgtctttcatgttttatgttattgatatcataatttacatcatttcatagtttgcattcataaagaaattattgcagcgatagtttttaaaaacagttttcttttttatctcttatatctcctattttcttttttgtctctcggacatttgccatagatgaacccatttcactctttttgttccctcttttggaggaagtcttatgattctgcaccttttcttgatcccacaaagccaggccaggtgctgagaggctctcatttattttccatagtgcaatcccaagtgttgaaggttaagcacttataccaatccagcagagttgagtcagctgtctgtgtgtgctcaagcatgacatgcactgtttcacatgttgtccatgaagacatacacagtgtgttgactataggagagaaggggaggatgtgactggaacaggagatatacttaggcttgttgggggagacctcaggtggtgtgttctatgaggactgtgggcaagtgtcttggtagagtccacaattagctaataaaaaactcaggcctttgttaagatccacaccctgattgttttgagtctttgtcccttttcctgctactaactgtcccagagtattcagtcattatgatctcctcagtcttcagagtgggtcaagcaagaagtgaaccttttgggtactgttgctcatggttgaggaaggcaagtgagtcctcaccatgctctcactttcttctgtgggaaaaatgggccaacgaattctgatatgatttgcctgtgtccccaccgaaatctcatcttgaattgtaactcccacaattcccacgtgttgtgggaggaacccggtggggggtgattgagttatgagggcaggtctttcctgcactgttcttgtgagtgagtgagtctcatgggatctgatggctttaaaaacaagagtttgccttcacaagctctctttgcctgctgccatccatgtaagatgtgactagctcctccttgccttctaccatgattgtgaggcttcctgagccatgaagaactataagtccagttaaacctctttcttttgtaaattgctcagtctcggatatgtctttatcagcagcatgaacacagattaatacagtaatttggtactgtcagagtggggtgccactgaaaagatacacaaaaatgtggaagtgactttggaactgggtaacaggcagagattggaacagtttggagggataagaggaaggcaggaaaatgtggggaagtttggaactccctagagacttgttgaatggctttgaatgaaacactgataatgatatggacaatgaaatccaggctgaggtggtctcagatggagatgagaaacttgttgggatctggagcaaggtgtttcttattatgttttagcaaagagactggtggcactttgcccctgccctaaagatttgtggaactttgaacttgagggatgatttagggtatctgacggaagaaatttctaagcggcaaagcattcaagaggtgacttgggtgctgttaaaagcattcagttttataagggaagcagagcataaatattcagaaaatttgcagcctgacaatccagtagaaaagaaaatcccattttctgaggagaaattcaagccagctgcagaaatttgcataaataacgagtaatgttaatccacaagacaatggggaaaatgtctccagagcctcttagaaatcttcacagcagtcccacccatcacagtcccggaggcctaagaggaaaaaatagtttcatgggccaggctcagggtcctcatgctgtctgcagtctagggactttgttccctttgtcccagccactccagctgtgactaaaaggggccaagatacaactcaagctgtggcttcagagggtgcaaccgcaggccttggcagctttcacatggtgttgagcctgcaggtgcacagaagtaagaattgaggtttgggaacctccacctagatttcagaggatgtatggaaacacctggatgtccaggcagaagtttgctacaggagtggggctctcatggaaaacctccgctggggcagtgcagaacagaaatgtggggtgggagcccccacccagagtgccccctggggcactacctagtggaaatgtgaagagggccaccatcctcaggacctcagaatggtagatccactggcagcttgcactggaaaaggtgcagatactcaatgccagcccatgaaagcagccaggaggggaactataccctgcaaagccacagggacagagctgtccaagaccatgggaacctacctcttgcatcagtgtgacctggatgtgagacacggagtaaaaggagatcactttgaagctttaatatttgattgcccattggattttggacttgcatggggcctgcagcctcttcattttggccaatttctcccatttggaatggctgtattgacccaatgcctgtatccccattggatctaggaagtaactaacttgcttttgattttatagcctcataggcagaagggacttgacttgtctcagatgagactatggactttggactgtggacttttgagttaacagtgaaatgagttaagactttgggggactgttgggaaggcatgattggttttgaaatgtgaggacatgatattctggaggggccaggggcacaatgatatcgtttggttgtgtcccacccaaatttcttcttgaattataactcccacaattcccacatgtcatgggagaaacctggtgggaggtgattgaattatgggggcaagtattttctgtgctggtcttgtgatagtgaatgagtctcatgagatctgatggctttaaaaagaagaaaaacaagttttctgtctgcctgctgccatccatgtaacatgtgatttgcttctccttgcattctgccatgattgtgaggctttcccagccagctagaactataagtccaattaaacctcttacttttacaaattgctcagtctcaggtatgtcttaatcagcagtgtgaaaatggattaatacaaattctctcttggcactgagctgtgatgcctgggggaaggagtaatgcaagcaaactgaaactattcttcttactctattaaatgtattcattcttgaaaatttgctttaacagggtgctgggatatctctctagatgtttaggatcccacaaagatactaccctctgtggattgttatcaatattgatgtttttacaggggaaagaagatagagactcctactctgctattctgttcatgtcactctggattccccaatttttacttctctgagaaagtctttatttcttctttacatttgaagaaattttttttgagaatacagaattctaagtttgtttcttttttctctcaacaatttaaacatttcactccactctcctctagcttgcatgttttcaaagaagaagttgggtgtaattcttatctttgttactctatgggaaagttagttatttcttcaggattcttttaatatttttatttatgtttgagtttccaaagtttgaatatgatatgagtggatgtagttttttgttgttatttatcttgcttagtttttttttctctcaagttcttggatctgtggtttatagtttgatgccatattgggggaaatgctcatttattagtgcttcaaatattgcttctattaccttcactgtttcttatcattctggcattcccataacatgtaagttacatcttttgtagttgttgcacagttcttggatagtctgttccatttcttttaagacttttctctttgtttcatagttttggaagtttctatctatgtatttccaagcgaaactcagatactctttcctcagttatatcttctactaataagcccatcaaaggtatttttcatttttgttacaatggtttttttgtacactctagcatttttaatattcttttttataattctcatctctctacttgcattatctattagattttgtatgttgtctacttcttctactagatttcattgcatggtaatcatacttcttttaaattcatgatgtgataattctaacatcactgctgtatttgtgtctggttctcacgttgttctatctcttcaaactgtgtttttgcattttagtatgtcttgtaacttttccttgaaaggtggacatgatgtactggataaaaggaactgcagtcactaggcctttagtgatgtggtagtaaagtgtgaggtaggggaattgctctgcagtcctatgattaggtttcagatttttatagagtctgtgctaataggctgtgaacttcacaaatgcttctcagtttgttcttttttcacctcattagatggtacaggatggccataggggactggagtggggtaaatctctgcctccacaggaaaagctagaatagctgcagttgaatatttttcttctttcaggtgaatcaggctctgataaaaacccaataggttgggctctggtaaaataatttttttgaaggcaggctttgttaacaggaacaggttgccatggtgcatttcaaaatgatttctttcctcctcctcttgcaggaagccaaagtagatttttctctgatcttcactgtgagaacctggtagaggtcttggaggtagaactcacaaaactgttagggttgtcctataaatgggtccacctggagttttcatctctcatacttgtctattctgagcctccagcaatttgtgaactacagttcagcttttcctgcattggtactggttcctatgaaggtgggtttctgctctggtaagttgtgattctctgtattcatcaacttgtctctccaattttgggggcagtggtgtgaactgtgacttcacttttctaacacacctaagaagaattgttgatttttcaatttgttctgaattttttttcttgttaggatagaatgctgacttctatgttcctgacatgccagataagaaactgtaggccttactagtattttttaatctaatcatattttccagagaagactcttccaacctccagcatagagactaaaagcctgtatcccaatattttgggagctgactgacaaaaatggactgaaggatcctggaatacagtattcacttttcacttaactgccctgctttctcatcaagaggagttgcatcttcctgtccagagagccctttgaattgccatttccagataatgtatcagtgtttgccatgatatatgggtagagatagttaactttctgaattcagcaagactgttctctcttttaaacagatattaaaccaggttttcttactttagtcactatatctttacttccgtttctatagattcttgatgcccccaacacttgattggtaatttttcagtgtgaatcaggttgattattgattttgccctccaacacttgcttagcactcagttttctcagttctttctcagacgtctgctttttagcttctaacgctttgtttctattgtctcctttcctattctccccaagtcctctgggtttatatcttaaaagtccctttattgtaattttaatggggtttaggaaagtagtgaaagttgatgttcatttttaatcatttgtctttacttggaaggtaatttcaaattatgtcaaaataatttaaccattataatcaatattttaaatgtcatgtaggaatattccaggaataattatatattaagaactggtagaagctaagatgattaagaagagtgatgaatataattttatatggacatgatataccttgttttaaagattatctacatttgtattgcccagcagagatgtttttgttaatttaatgttgccattatcaggacaaatgtatcatcattcagatatctccttaaacattatctactgaaataaatctttcattcattcatcaaacatgtattgatttcctactataagccaagtattgtttaaggattaggggatagaaataaagagtatatcacatctaaaatatattaaagacttctaaatgtacaactataatataatgaactaagtgaaaagtaagatttttcttcatttccccaggtggtagattcctgctgttactaaattcttaatcgtcattatacatttcacctcctgtgcacactgctcctttatttccttatattgcctgttagacaccaccctgattagattccttcactcccaagttaatattttttaaagtctttccactggatatactttactgaagattatctgatacccaagagagggattaacatgccatgcaacacagcagagcatacaactcaaatttatgttagatatcctttttgttaaatacccctttgccatttcaaacaatgttaccttctcactgattggttcacctcatcagtccctggacttcaattttactgcaggactcttccttctgtttctttttagttcttcaaaaattatctgggtctcttatgtagaacaattcaattttcttcaataaattctgggcccatgtttgtgtattagccagagtaggctgatatcattggtttaataaaataaatatttaatatttatagtttgctgtgggttcatagagaggcttcgtttcgtgtagtcattcagggtgcctgaacaaaggtaaaaaaatacttgaagggtagcccaggaaattactggactgagcctgaaagtatcatttatcagatcctcttacatttcactgtccagaactcattcatatgtccccacttaactgcaagagaggtgaaatgaaatactctttgatgaatgtatagaattctttctgccacacttaaaaaaatactaggttgatttgcaaaataaaagcctgatctgaattatactttattttactggaattttagtaaactttttttcttgtacatgagtttttcatcttacgtaggccttcctgtctgagatgataatcccaacccttaaaggagaagaggctcctattaattatggttttttgtttcattttctgtttattttagtgacatgtactgccctgtttattacatctatacttagtcaagttcgtacaatgtgcatatataatttactatttaaaaatttttactaataatacttgaggaattttcttctcatgggttgatcttatctactgtactctaacgtgatactagatgcttttaattctgattttaaccactaggatcaatgttaggtcaatgtctctggagcttgttgactgcagcagaaaatctgtccctacattttgtgaaaccccacttttcttcattgttcccttaggattccctactcatcgtttccagcttgtcagctactttctttatttttatttcatattggttttcaagttattccctttagctaccttgacttatcactgtttttttttaaactttgattgctcctcatgtttctataatcagctggatggttgttttttactgcttatacatttagtcccttaaagtgaaaaaagttaatgagtacttcagttccttccatttgctccgcattccctgaccttcctgttaattttagtctcccagtgtgttgtacacattatagttgtattttgtacaactttacttttcagcattttaatatgtgaatcagtctttgaattcatcttttgttttgttgtcatgtgacagtctttataaagaagttttggaatcagcaatgctactccttaaattatataataaattaaggttgcataaactgagttcaggaagggttttctgtaactatagtatggtttgaggagagtataattcaaataatctaggaaaaacaataaaatgttttattcaaatttggattgatataaaatatttttcaaatgcagcaattttaataaatagattagtttagaggctagctactggtctgttgctatttctgatgggttagtctcttttttagctaatgggttaatatgggtgagcttattagagttaccaatgcaataaaatccaaacttttacttttgaggtaggaggaaatatgtttaaaaaacaaacgtttttgttggcaattatcattgtataatgaatactctctttgaaggatatggatggagaactgtttcttgcttagtaaatttgtggagtagttaacacttttgtattcttgacagtaataggtatgtaagctttcctgtctccagtgttctaggaattgtccctccccgccaccacagggatgggtgatgagcacattaccaaggtatggccaattagtttggccattttgattgttttatagagaaatgtataatccaggcatggcctattagagttaccatgatgcctgaaattttcagagaaaattactttccctctcatactcctaaccccctctagagttgcagtagggaccatgtaagttggggagctgctggaagttcttactaccatcacccagtgatcccctttctaaggacaaaacagggggaagtgtgggaggcaggtgagggataaaagactacataacgggtacagcgtacactgctcaggtgatgggtctaccaaaatctcagaaatcaccactaaagaacgtatccatgtaaccaaaaaccacctgttccccaaaaactattgaaacaaaacaaaacaaacaaacaaacagaatgaggaaaacagctgcaaaagggagagatagaaagaaaatttcttgatggcatttttgaagccctgtatctagttgtgtctgaagttagtcacctatcagatttctcggaaaagtaattcattaagttacatcgtaatttcagctagttttgcttcagtttctttcacatactactaaaagtgccccaactgaaccagtagactacctagattatatatatatattaatatgtatctatagatgtagtcatctatctatatctatgtctatatagatatctatctacatctatgtctagatctatatataatgtcgtaaaataaaaatattcatttagaagggtaagaaagggtcatttctatattactcaccattctatctctatcatatatcatggtgactgcacatagacatatatcatattactccccaatttgatcttgaggtctctctctacagagtggctataagctctagccctacccttacaaggctccaggggatgtggttgtgggttttacaatgtgtctttcataggattctcctttatcttagcaaacagcctaatgcctaagtgtccaacccatggccccatgtccctctcatagtaaacttgtttatgagggcaaatataacaatttatggggataaactggcaaatgtccttgtggctcttgtctgagctgtgtccagtttattcctgccaaaacagccactatctaggagagcattgactaggaggcaagttaggtctgggtgtgtcggtctgaggagacacagaggaggcaacataataaaaacacatgaaatattaataacacaagtggtttattactcgcagatccatgagagaaaaggtgtacttatgaaggtaatgggaatgttcctgaagaaataagctcaaccaacaggttgggagccagagagagatgaatctaccggctgaggcatttactggggtctaggacattacctaactatgtttcctgtggggagtgctaatgagttggtgaggttaaggtaagcaggtacaagtttcatggaactatgctgtgactgacagtggtcactgaagcatatctgcacagtttatgcaggttgtggggctcagtaggggaagttaagtattttgtatctgtatatagtataggatgatggtcaccaggagatggttggataaagcagatatccagataaaccatattgagaagatgggaggagacagagaagtagaaactgtgtcaagggtgaataaaccctgtttctggtatgagcaagttaaacctagatccagaatgaatgccaagacaggatataattttagaagttactacaacatgtttaataaatattcatgaatgaacaaataatctaactagtccaatttattgggcccctgttttgtgtgaagtcctatcttaggagagagtaaaataataaaaagagtaagagactttgtcctctagttgatgatgttatgcaagctttgagttataagaaaaatgtaaggtagattaagagaaggggctaaaggaagtgaaaattgtacattgaaaaatagctaagccatgaaagggcactagagttagactacctgagtttgaatcagtgctctattcttgtgaactgtttgatcttggatatattacttaaacccagtttccttatctgtaacaaaggaataatattgttacgttcttgatagattttctgtgaggataagtcaagatattctatttaaaatgagttaaatgcctaggatatgttaagtgctcagtaactattggctatttttatttcaggaagcaaagatgggcagaacatgatttaaatattaaggaaaagagaattggaagcaaagtcaccctgggtatctgaatatttattgtattgcaaatcaacaccaactatcaaaaaaatgcccacaaacgtaatttaacatacaatatataatccagcaaaattttagtgttgcacaggttagatttacacaatgataggtttattttagagattagttaagacttgaatctttggtagacaggagggaaaaaaagacctctacgttatacttaaaaaatttttaacaagaaaggacttagagtttaaaaactttgagtgataattatagtgttggattttattagatattctgcatgaggaaaaaagtggattaaaaaagtacatttaattgtctgctaggaggtagatatgcagaagattattacatagctagatggaaaaggacttcttgagtctttacaatacttaaagatgataaaatttgatagaattttatagactcattcaggaacaaatgcctttctatgtcataaaatgctgtttgtaattacattttttcctaactttaattcttacctcatggtaaaatggtagttacctgtgggtctctggatacaaaggaaaatgaaatcccattaatagacataaagtagcttcatatatgtttaacactgctggtctacacatttcaaaagcatgggggacttccacttgattcaagggtcttatggagaaaataaaacagcattgtatagtagaggaaagaacatacaaacagattaaagctatgtgaccttgaacaaattaacctttttgagcccaaggttccctgtgagtagaaagaagataacaattatagtgtcttgtgaggattaaagataatatttacagagagagaaattttttggcatatggtaggagatctaagatagataagtatgaataaataaaactgttgacacaaaatgttaagtagcaacttgcaagattttgataaatactgatagagtcttagctgatgtcatcactaatgaatagttgtgttcagcactgtggcttaataatttcattgcccccgcccagtccagtgatacatggatcaatgttgaccagacagggattatgacaatgaagccagcgttccatgctttctcttcttctcaggctatatgccctttttatttagcatgtaaaggaagcgttagtctgcccagttttcctttcttcttagttcactgaaaagcttctttaccttcacaaaactaggttcctcaggggcattctcaatctacttcacaccatggaaggatgaagccttccttaagagctgcaaaatacatattgggatgttaaaagtagttacttactggttttaaggactttttattcgtttagatttaagctgatcaaatccccaaatttagattttagcatatatgagtttatccattggtccaagattatccttagaaggtcacaacgttttattttctttgtctcttttccttcctttttgagaaaaagattactatataaatggtttatttacaagagtttgaaactttttttaactttagtcagatattccttcttttctgtttttttctttctttctttttttttttttttttactttttttcctcataagaaacttttcaaagcagtctggcatttaaaaaatataaatctagtttacagtcccaccaacagtgtaaaagtgttcctatttctccacatcctctccagcacctgttgtttcctgactttttaatgatcgccattctactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgatttttttcttgtaaatttgtttgagttcattataattctggatattagccctttgtcagatgagtagactgcaaaaattttctcccattctgtaggtggcctgttcactctgatggtagtttcttttgctgtgcagaagctctttagtttaattagatcccatttgtcaattttggcttttgttgccgttgcttttggtgttttagtcatgaagtccttgcccatgcctatgtcctgaatggtattgcctaggttttcttctagagatttcatggttttagatctaacatttaagtctttaatccatcttgaatgaatttttgtataaggtgtaaggaagggatccagtttcagctttctacatatggctagccagttttcccagcaccatttattaaatagggaatcctttccctatttcttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcgattcctcagggatctagaactagaaataccatttgacccagccatcccattactgggtatatacccaaaggattataaaacatgctgctataaagacacatgcacatgtatgtttattacggcaccattcacaatagcaaagacttggaaccaacccatatgtccaacaatgatagactggattaagaaaatgtggcacatatataccatggaatactatgcagccataaaaatgatgagttcatgtcctttgtagggacatggatgaagctggaaaccatcattctcagcaaactgtcactaggacaaaaaaaccaaacactgcatgttctcactcataggtgggaattgaagaatgagaacacatggacacatgaaggggaacatcacacaccagggccttttgtggggagggggaaggggggagggatagcattaggagatatacctaatgttaaatgacgagttaatgggtgcagcacaccaacatggcacatgtatacatatgtaacaaacctgcacattgtgcacatgtaccctaaaacttaaagtgtaattaaaaagaatatataaatctttgctgctatttttgaggaagaggtaggtccagagctctgatttttcatccctatcatctccacagcttctgcagtacctcccaggaactacaggtttcaggaaatacattttaaaacctccatgttagtgaaaaaagaactggaattcttgagacttgatttttagcattagttctaccatcaaatttgtttgtgtcactgatagggttaattgtttcatctgtaaaacaagcggtttagaacagtggttctcaatttgggctgcgtattagcatcacctggggagttttaaaaaaatcctgatgcttaggcctcactctataccaattaaattagaatctctggggcatgacccaggcagccgtattttttaaaacccttctaggtgattctaatgtgcaaccaggttttaaaaccgctagagaatttgtgagcaataacgttccccaagtccatgagtctgtgcagcatgttttgctagatgtcgttaacatgtgcacagagtccagtataaagtgaggatgagggatgaaggtagacataaagatggaatctggaaaatggttttttaaaaaaatcctagtagctctgtgttttgagcaaacactttgttatatccctgatgggaatgattttaacttcctgtaaaatgaagttctcaaatgggaaattaaatttaaatgcaatgttatttttatacaaataatatcgtttgttaatctaattagccaagaattatgcctaaatattttattcataaaacaaatagaaaaggcaggttgactacggaaatataagatatggttaatattccttagttgatggtatagattttaggcatattgaagtaacatgttgctaacaatgaaaatctctgatacttatatagtgtaagttaaaagtccctgcatcaaaaatgttaaaaacaaacaaaacccagaattactgcagtgtgcatattgtccattattaaaaactattgtttcacagttttcaaattaggaaacaaaaatttacagcattggtaagcaattgatcttggaacatataaaaattggatgacattattcgtgcaacaatctgcaaatgtcaaatgaatttattatgattggataaattatagtgaatactaaatagtttaaaaatgataacacagttggaataaaatgattgatattaagtattttagatgcataactaaacagaaatgacttttcattttattaccaaggccacttacatattttttctcatatttgtgcagctaatgagcattcaagattcatgtgctttaatctccactttttaacagggtagttcttttctgaaagttggtaacatttaaataaaagaaaaagtgctgttatcacttgaggcaagacaatatattaacaattttactacctattctttaggctttttttttttttctgggatagatttaccaaaaacggaacaaaaaaaaatttacacattttctggacagaaaggtcagtcggtcttttgtgtttttgtattctggtctccttaccctagagaaaaattcacactagccttttcatgtggaagtgtcctgaggggttagataatatgccccaacattgacaggctagattttgacaatgtggaatggagccagcagcggcattgaccacttctcaatgaaccatggtaacaaagacaatgagttcttttaccaatgatcatgagtgactgcttgttgagaacatcccaacttccttctttttttccagactgtagattctgatgtcctggtacaatataaagtgagtaaggagaatgggtcaggtgaggagagggaaatagagtgtgtaagaaaaggcgggtagttggggagagagagagtgagagcaagagcgagcacacgcgatatgggaggtagcgggaataggggaatagaatgtagtagtgaaacagaaaacgattgatgtggtattttcaccaaatttggccagtagagactgggaactaaatataatttggtttagataaattaaaggcatttaacatttttctgtactttctgtgttgtggcacaattcttagttgtcacacacttttaaaaatataaaattggtacaaataacgcccaatatttggtcattagtgagttatttctttttagtgaaaaatatctaaaatgcttctgtgaagtcttcttagtttaccatttacatagggatctctattgtcaacttaaattacttactatctacaccacttattttgtggctcattgatatacttctgtgagacatttctttggttgtctcctatcataaaactcatatactttattaacagatctaaattttaaacttctaccatggtaggaattgtctaaaaaaaagttgagtaagtgaatatatggatattcctctagagtgagttgtctaagggcaggaactaagaataccattttatccatgtgttttcagcacagcacagttcaggcaactaggaagtgctcaatacttgattgtcaacaagtactgcatgaatagatgaatagactagtatggaattaagacccaaatgcatatatccacctgcagagttgattcattcatatctcatgaaagattcatttgttagatccagatatgaatttttaatccagtacaatatgtgctttttactaatatattgtggtaaccagtctgattaatgtcaacaataggggatatttagataaaaatctcatacaaattatgaaatctatccttaatttttcaaccaaatcttatattttatatttattttctctcttatgcaaaaatgaacatagtcacccagcccaacatactcaatttctgtcaagctccaacgcctaagcactgttagtttttttttaaagtttattatgagttgcccaaaaacatcccaacaggccactgtactttatcttagaaggatctgagcaatgaaatccagaagttcttttggtgaagaaaatgttaggaatctcttttaaagtatttctgtgctagtttaaagaaattctttgaaattctcccatcgagatgtagggtctgtttctaacaccaggaaaatatgacagaatttgtacttggtgacttctgagaccaggtcatgaaaggccatgggttttctgatttgtttgctgaaacactgaatggtgacctggtaagtctgactatcctcaggtctttgatcattccatcaaagtccagctgtgaagaaccatcttggtaagtgggtcctaagccccagctcttctagctcccagctatttgagtcaccccctaaacatcaaggagaagaaataagctatgctttgtctgaattcctgacccacagtctctgtgagcataataaaaatgtttgttttatgcctctaagtgttggtgtaattttttacagaaaaagagtaaatggaataaattttgtatcctgaagagtatattttattttaaaaactataatacaataagttttgtatttaccatttatgagtaatatataatgctatatttaatttaatctaagaaactcctaatttactttactttctctaccctttcaaagtttgaaatcactaaatgataaattcagtgactcattttagcatattgtgagcccatttgaaaagtatctcaatgttacttttagttccttttccgtttccagtaaatataaattcctatagtgttctgctttttactttcattgtgcctgaggcaatcgccatggaggctggatgtagcccaggtttcttgaaggcattgttcttggcttgagtcacttttccactggactctcttctggcatatgttaatatacatgataaaataaaagaattccatggtcaaagaattgggaaacatattttaaatgctcttcttagagagtcataattaatgttagcatatttaataatctgagaagtcctagtataaggaaatctgtttgactctgtttcattcagtgtttctgaactcttttgactatacccagatcatgtgaccatgcaacactctagagaatacgctttttaatatctaatgtcttgtactactggtttagaaaatgcttattgatctagagagagtagtaattagaaaatgttcataattagccaagtagtaataagtaactattagtaattagcaaaattcaaagagcttactttattttttctttcatttatatacactctttgaaattattaagtatacaggaacctaaatgatggccttaaaaactctaaggaatgaatgattgataaatgtgaagaagaattgtaggagataagatcagagaaaaagggattagcagcaattaaggactattatagataatataggtcaattattatgaatagctctatccctcctatatggttccagggtgtttatcagagtttccaggagaagcataacaaagtgttggaaatacacatatttaaatttatgattatttaaatttgcctttaggtgtattgtttaactctcttgcatttttaaataagagtagaggagggtgtaatcatgagtataaaataattgagagcttgaggtctgagtagaacagaaaaatcacagctttggagagtgaggtaacacctttgtatcccagtctcgttggggaatggtgtattccggtcaaccaagtctccaattacttcattttgacagcaaaactgatattagagcacagatgtgagggttgaactatagaacgctctagattgatttttcaagtgctgtatacatttttagaaaagcagcactttaacagctacaaatctttaatggagttgctagaccatcaactgacatgtcaacacaccttgaaagaagcctcatcaaatgcaaaggtaaagttctgtcagatagtgttagcaaagcaaaataaactcataggaagaaggaaatatttcttccaaatacctgagtgttataaaataaaacacttcaaaagtccttagatgtttctaatatgtaatctgggtaaaaagataagaaatggaaaaagcaagaaggtaaatgaaagcacttcttaaaatatttaaataggaaatgataaaaatgtaaaagtgaaactgtgcttattagtgggggaaaaaaacaactgaagttaatttcaagctgccataggataaaagcaaagatgagcaagataatgtgtcactggcttggggaaattaaaaaaaaaaacattgttaatacttaagccagaacctattaatttctgacagaaactattgatttcagaaaactagataatttctgacaaaaagggttctaggtcaaataaatttgggtcaaacaataacaagtctttttattgagtctttattacactaatgtgtttttcaaatcattctatagtgtttcccaaatttacttggctatggaaatttttgtttgtttgttgagacttatcctcttttgggactcaggtccaaggagcaaactttgggaaacactgatctagcccttttgtttgataaagctattattgaccttgctatgagactagctgacaggtggcctgtaggcacctcatggctcctgccgttagtactcatggctctaatgactgaatttaggtggaacttgtgcccttccctggcttaaatccacaaattaatttttccatctataagatagggattatcttttgcagaaggtaaaatgagatgaagaaaggtgataagcctctcaaagtcacacaacatgaacactacatgtcagaatttgaactttaaacttctttctcccattctgctgagtattgccttccaggttaaaaaaatatatagtatctgtttttagttaaagagtgagctgtggcttggattgagcccctcttctttgaatgggactctggtttaactaaaatttagagaagttctgaagcttttaatgaaaggctacatttatcaaaaatagggcccactcattaaatactaaggcttatatcattaagaaacaatagagaaaggaagaaaaacctattcccagtttcgatgaaaagagagaaggcttttaagaaataagggtggactttccaacagagcagtcatgaaaagttgaatgtccaaaatgagtacattttaaagaaatatataaatatttttcttcagacacagaaatattcaaaagatggttacacatgtgaacgtgaaccttggaagggaggactggctatagggaaacactggccatcttcatgaataagaaatttgaaaatgaaggagcagttggagttatattaatggttctcaaattagttctctttctctttctctttctctttctttctcttctcttctcttcttttctcttctcttcccttcccttctcttttttccctcattctcatgcttctatatactttttcatactttgactgctttctctttgtcttttataaagtcatctttatgaatcagatagctaattgtggaacaccaatgggattattgaattctgtgatctatttgtagagtgctagtagttctctggcagggcctttctttgcccaaggaccagttacattgtggttgtggtggtggaagtctctttatatgtttgcttgtttttccaagatcaagtggcattgccttattcacttgcctttccccatttaccgttttcaatttcctaaaaggatttttccatgtggtctgtgatgatttagctattgaaagtagattggttgtctgaaaactggctagtttccacaagaaatgtttactatatattcctaatttgtggaaattatactttgagaattattgataaatatcctgatacaaagtttgaaggagatcacgtaggggaagagaaggttggattttctaactcagcctttgcaaggaaagatgcaagagctcttaaaagcaacccctcttgaatgtggttactgacttttactgttcatgttctagcagagtgagattttcaccctggaaaactcgggcactgtacagttttctaaacaaatacagttcaactcatcacttcttgtcctgaggattatgtagatcattggtaagtgaatgacacatcatgtatgagatatcatgtttctctggtaatgggtgagcatcaacttcaatgaacatcatagtcagaaacaaatctcaccctagtgtaaaactttgaaatcttaaagtgaaacattctacttacttagaaattggattattaggccgattctctttatggcacctctcacatttttcttatttgctacttgcttatatctattcccatcctctctgcctattcacaggaaggtaagatacatgtttattgttgcattgctgggctaaaatagggctgggcacatagtagattttcaataaatgtttgctatatgaatgtctcagggtattaataaataaacacatcttcattttaagggaaagaaattgagtcaggtgaggttaagtggtttaccaaaaagtgttataacgaactcatagatagactagaaatataattctgtatcctaattctgaaaccagcaaaatatacctctgtgtcttttatctggtgtaattgcacatgtttactaaaaaggcatttggaattttagactaattatatgccaggactaagataagttctgtctgatggtgaatccttgttttaatattatttgtaatctgttgacattatagtttttgaattgtctgagattttttctcacattttagtacattgaataaatcttataaacgtgaaacttactttttaaaatctgttacatagaaatttggtaacattcttttattagatgaataaaataattgcaatagtaattcaagaaatcacttcatagtattcttatgaattatttttggttgtaaatctttataaattttatttgtgtactaatattttgctcagatagtcatatttttattttaaagggattaattttacattctcttatactttagtagtaaaaagtaattgtttttggtagactgaattgtgtttaaatttttctcactctctcctttctttttcttttttttttgagtgggagtcttgctctgtgccccaggctggagtgcagtggcgcagtatcggctaactgcaagctccacctcccgggttcaagtcattctcctgcctcagcctccagcgtagctgggtctacaggcgaccgccaccacgcccggctaatttttttgtatttttagtagagacggggtttcactgtgttcgccaggatggtctcgatctcctgacctcgtgatccgcccgcctcggcctcccaaagtgctgggattacaggcgtgagccaccgcgcccggccccttcttttcttctgttttcctgtccttcttccatgactcagcaattctctacttggtggagtgtctggcaatgccctgttcttcacctgtgtggtggttacacaggaattagctttataattactggcagttatactaattataaaccatataactgtgtgtttcatgtactgatctgcatacatagttaataaaaattaaaaaaattaaaagcaaagttatatagtccatatgtttccatctagaatggatttaaatttaatgaaacatttgtatgtatcattatttctgattctcagaaatttataaaagtttcagagtatggaactttctatttgtgttccaatttatttatgaataagtctctaatagacaatgcatataagtgatttattccacttaaaatttattttttattagacatgcattgaattatataaagaacattaaggatgagaattgcctgttttattttttgactcttctggcataagtaatcaagtcaattttagtaaaatttctaaaggacaaggtaatttcaaatactttcaagtacttttcttctgttgtctgtagattacacatagaggtgtgtaattaaaaacttaatatagcctctagtagatgaaacatatcttggataaacttttgctcttttatcctttagaacagatgtgtttatcacatatttctcaacagaatataattttgtttaggtcattccgccaacagaaaagaaacaacatgcctatccccaccacaccctaatttaattatggatttattgctttatggatattgatattcatggatttcaaattcaaatatgaacagagtatattttgtagaaaaactaatattttaaatggtgaaatttaaaaacccataataacatcattacattatttgtaatatccagtgcgaagacaatatactatatatagttattttatttcccatctgatagggtatttttgcacaaatgtaattctacctgtaaataaaatactgatttatagtcattggaatgtgagactatagaaggttttcccccaatttttttaaattaattctccttgttaaaagggaaagtaaagcccataaataagttaaaaaacgtttgactcagaatgtaatcttttgatcataatacaacaatagatgtttgtttcttttgttgtagaataattaaggtttagtttattttattttttattttatttatttatttatttttttaatttattattattatactttaagttttaggatacatgtgcacaatgtgcaagttagttacatatgtatacatgtgccatgactcatcatctagcattaggtatatctcccaatgctatccctcccccgctccctccaccccacaacagtgcccagagtgtgatgttccctttcctgtgtccatgtgttctcattgttcaattcccacctatgagtgagaatatgcggtgtttggttttttgatcttgcgatagtttactgagaatgatgatttccaatttcatccatgtccctacaaaggacgtgaaatcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttaaagtcctttggatatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggctttgatttgcatttctctgatggccagtgatggtgagcattttttcatgtgtgttttggctgcataaatgtcttcttttaagaagtgtctgttcatgtccttcgcccactttgtgatggggttgtttgtttttttcttgtaaatttgtttcagttcattgtagattctggatattagccctttgtcagatgcgtaggttgcgaaaactttctcccattttgtaggttgcctgttcactctgatggtagtttcttttgctgtgtagaagctctttagtttaattagatctcatttgtcaattttggctttggttgccattgcttttggtgttttagacatgaagtccttgcccacgcctatgtcctgaatggtaatgcctaggttttcttctagggtttttatggttttagatctaacatttaagtctttaatccatcttgaaatgatttttgtataaggtgaaaggaagggatccagtttcagctttctacatacggctagccagttttcccagcaccatttattaaatggggaatcctttccccatagcttgtttttctcaggtttgtcaaagatcagatagttgtagatatgcggcgttatttctgagggctctgttctgttccattgatccatatctctgttttggtaccagtaccatgctgttttggttactgtagccttgtagcacagtttgaagtcaggtagtgtgatgcctccagctttgttcttttggcttaggattgacttggcgatgcagtctcttttttggttccatatgaattttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagctgaaggagattttgggctgagacgatggggtgttctagatatacaatcatgtcatctgcaaacagggacaatttgacttcctcttttcctaattgaataccctttatttccttctcctgcttaattgccctggccagaacttccaacactatgttgaataggagtggtgagagagggcatccctgtcttgtgtcagttttcaaagggaatgcttccagtttttgcccattcagtatgatattgactgtgggtttgtcatagatagctcttattattttgagatacgtcccatcaatacctaatttattgagagtttttagcatgaagcattgttgaattttgtcaaaggccttttctgcatctattgagataatcatgtggtttttgtctttggttgtgtttatatgctggattacagttattgatttgcgtatattgaaccagccttgcatctcagggatgaagcccacttgatcatggtggataagctttttgatgtgctgctggattcggtttgccagtatcttactgaggatttttgcatcaacgttcgtcaagggtattggtctaaaattctcttttttggttgtgtctctgcccggctttgttatcaggatgatgctggcctcataaaatgagttagggaggattccctctttttctattgattggaatagtttcagaaggaatggtaccagttcctccttgtacctccggtagaatttggctgtgaatccatctggtcctggactctttttggttggtaagctattgattattgccacaatttcagctcctgttattggtctattcagagattcaacttcttcctggtttagtcttgggagagtgtatgtgttgaggaatttatacatttcttctagattttctagtttatttgtgtagaggtgcttgtagtattctctgatggtagtttgtatttctgtgggatcagtggtgatatcccttttatcattttttattgagtctatttgattcttctttttttctttattagtcttgctagcagtctatcaattttgttgatcctttcaaaaaaccagctcctggattcattaattttttggagggttttttgtatctctatttccttcagttctgctcggattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgcttcaaatgcgtgccagagattctggtatgttgtgtctttgttctcgttggtttcaaagaacatctttatttctgccttcatttcgttatggacccagtagtcattcaggagcaggttgttcagtttccatgtagttgagcggttttgagtgagattcttaatcctgagttctagtttgattgcactgtggtctgagagatagttagttataatttctgttcttttacatttgctgaggagagctttacttccaagtatgtggtcaattttggaataggtgtggtgtagtgctgaaaaaaatgtatattctgttgatttggggtggagaattctgtagatgtctattaggtccacttggtgcagagctgagttcaattcctgggtatccttgttgactttctgtctcgttgatctgtctaatgttgacagtgggctgtcaaagtctcccattattattttgtgggagtctaagtctctttgtaggtcgctcaggacttgctttatgaatctgggtgctcctgtattgggtgcatatatatttaggatagttagctcttcttgttgaattgatccctttaccattatgtaatggctttctttgtctcttttgatctttgttggtttaaagtctgttttatcagagactaggattgcaacccctgccttttttggttttccatttgcttggtagatcttcctccatccttttattttgagcctatgtgtgtctctgcatgtgagatgggtttcctgaatagagcacactgatgggtcttgactctttatccagtttgccagtctgtgtctttgaattggagcatttagtccatttacatttaaagttaatattgttatatgtgaatttgatcctgtcattatgatgttagctggttattttgctcgttagttgatgcagtttctacctagtctcaatggtctttacattttggcatgattttgcagcagctggtaccagttgttcctttccatgtttagcacttccttcaggagctcttttaaggcaggcctggtggtgacataatctctcagcatttgcttgtctgtaagtattttatttctccttcacttatgaagcttagtttggctggatatgaaattctgggttgaaaattcttttctttaagaatgttgaatactggcccccactctcttctggcttgtagagtttctgccgagagatcagctgttagtctgatgggcttccctttgtgggtgacccgacctttctttctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaatttctcctggatgatatcctgcagagtgttttccaacttggttccattctccccgtcactttcagccacaccaatcagacgtagatttggtcttttcacatagtcccatatttcttggaggctttgctcatttctttttattcttttttctctaaccttcccttctcgcttcatttcattcacttcatcttccattgctgataccctttcttccacttgatcacattggctcctgaggcttctgcattcttcacgtagttctcgagtcttggttttcagctccatcagctcctttaagcacttctctgtattggttattctagttatacattcttctaaacttttttcaaagttttcaacttatttgcctttggtttgaatgtcctcccatagctcggagtaatttgatcgtctgaagccttcttctctcagctcgtcaaagtcattctccatccagctttgttccgttgctggtgaggaactgccttcctttggaggaggagaggcgctctgctttttagagtttccggtctttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccgtgtgaggtgtcagtgtgcccctgctggggggtgcctctcagttaagctgctcgggggtcaggggtcagggatccacttgaggaggcagtctgccggttctcagatctccagctgcgtgctgggagaaccactgctctcttcaaagctgtcagacagggacatttaaatctgcagaggttactgctgtctttttgtttatctgtgccctgcacccagaggtggagcctacagaggcaggcaggcctccttgagcagtggtgggctccacccggttggagcttcccggctgggctgctttgtttacctaagcaatcctgggcaatggcgggcgcccctcccccagcctcgctgccgccttgcagtttgatctcagactgctgtgctagcaatcagcgagactccgtgggcgtaggaccctccgagccaggtgtgggatataatctggtgcggcgttttttaagcctgtcggaaaagcgcagtattccggtgggagtgacccaattttccaggtgtcgtctgtcacccctttctttgactaggaaagggaactccctgaccccttgcgcttcccgagtgaggcaatgcctcaccctgcttcggctcgcgcacggtgcgtgcacccactgacctgcgcccactgtctggcactccctagtaagatgaacctggtactgagatggaaatgcagaaatcacccgtcttctgcgtcagtcacgctgggagctgttgaccggagctgttcctattcggccatcttggctccacattcagcggtttagtttattttaaaaagagaaaagattaaaaggaaaaaagaaaccaaaaggcagatatagttctaatgaattagtcttagaagtaaatcagcccactgggaatgaacttcttttgaaaatgcagtgtggagaaacaggttaaactctgatttttgatgacagaagcaaggggataaaatttatatacagattgaattctggttgtatttctaggacagcatttgtgcatgctgctttgagacccacgtcaactctttatctttctctttgacagatcagtattgaaatgagaagcccagcagctactaagccctggtgcaagtgttctttccacactaccaaactctctcttattgttctattacttaggttcttcttatggattggttacagatatttaacttgagagagaagacaaggaaaacccattaaataataattgttgggaaatttactgtttaagttacctggtgtttattgatgtctgaaattttcaacgttcccagtcaggttagagatataaatgaagtgtgaagcttaccatatccggaggacaataccttgtatgtacttatttgctgatggaatgaatggtaattatatgaatgaatgaataaattaatgaattacagatagaaaataattgtaaattactattacaagttgaactaaatggaacacttaagagtaggccaaccctacacttgtggacggataagaagaaagagagctaacacgtagttggggggaacaacaggagaatttatgagaatagcagatcaaatgtaagatgcattttgaaggattacaatcaagacatatttcatggaggagctggcacttgaggtaagtataacaacagtttaaaataacatcagatttctttttttgctatcctttctacaaattgcaatgagaacactgactcttctttaattttgattcttttatttgaaaactgggttaattcaaataaaattatccttccttagcaaaggtaggatttctttatcgaatgtcatcttcattattaacccaatttagtgttataagactttcacactttttacggaatagtgcatggcatgttgtaaggggttaatgtttattattcgactgactgtatatcaagttatagtcacagtaatctttaaaccaagagcttctacttttctggttcctgccttgatcaactttccttttttttccccctgtggctctgtctttggacttccattctgtacctgaactatctattggtagtctcatcccatctcatggctttaaatatcatctatatgatgactatttacaactgtacagttctagcctgtaactctcccttggactccaaactcctatatgcactacttaaatgacatcttttgttggtatttaatagttacttcaaacataatacatccaaatgaaattctttagtttgctcctaacagtttccccaccttgcttaatgccacctgaatttctccaattgctcaaaccaaagacactggagtcatcattgtttcttttatacccacgtccaattcattagcaaatctgttgcccctattttcaaaatatgttcagaatctgaccatttctcttaaggtccattgctaccaactcttcattgagggacattatgttggtagcttgaaatcagccatcatgagagtatttacacctcggaaactggcaaacactacacattggggattattttctgagagactgggttttaacacatttaaaacacctttggctgttgggtaagctatagccatgtactttcctgcatgaaggtcagggattttatttagccagtcatggtaaaggaaattatgggaggtgaaccaaccaggagaatctgcattgtaaaaggaaattcaaatagtcatgagacaggaaggaggaaaagaaggattggtagccattattagaggcagccagtacattcttgtatcttttccagttggtaattgaatgaacaaaggtctaggattcacattcctgaaaatggaggcaaggtaatggctagataatcacaagactttagccacataggttagagataaggacagggttccattcctaatgaggaattggaaatctagacagggacattgtgaagaatattagtcagggatgtaatattatctggagaatggtgtcttggcaagattaataacttaatacccattaatattgtttatcacactttaatatttttatttcaatagtttcacactttaatttttgtccaaccctgaaaacagtggttctgaggtttatgcatcagcatcacctgggcttgttaaaagacattactgggttccatcccagagtttttgattcagtatgtctgtgtcaaggcttgagaataatatatgtctaagaaaatctccaaagatgttggtgctgcagatctgaatgtctcaatttgagaaccacttatttacggaaaaagcaaggagcaggcagggatggtggagactgcccgttgtttttgatgccccttgctaatgatagctgtgcccaacttccctaatatggttgtgagcaagtcagctatagccccaaatgtactgtctcaaaggttctgcagttagccagacccttactctttggaaggcagtttggtttccttgatggtattattcctttttccttgggtggcttattcctactggtggcatgcagtactcttcctgaaaagaattctcattcatcagtattcaattaaattttcagaacaattatgatcctagtgatattttattgtccttgattagctagttcctcaatccaatactgagtttagtcacatgatgtagaataaattggaaaatacagagttccagtggtaacaaagatgccagttcttatccccagcccaaaggatattgcaggcatagaaaacaagactgattttatgctctgttggttaggaaattgagctgaatagattttctttcgaaaattagataagtggttctcaaagtgagatactcagacctgcaacgtcaatgtctcttgagatcttgttggatgtgcatatcctcaagacttgccaaagacatactaaatcaaaaactctaggatggaacccagtaatacctacattttctgagagagagagtgtgtgtgtgtatgtgtgtaagaattgttagggggaacagagagagagtaagctagaaaaagaagtagaagtgtacagctgaatctataggtagaagaaagtatcagaaactacctgggaagaattagaaaaagtaggggttgctacaatattatatttgttccttataaggtcatagtcatctgataattagcaaaaatgtattaaaatcttctgcgcatatgatatactaatgatatagtaatacagctcacttgctaattacacatatttttaaaatttattcatttaaaaaatcactctagggactctacaagtatcttactccacgaatgaaagatgaattgcttgaacttgtaagcttttgttttgataaaggcacgttttacatttcatttactttttacatttcttttaaaagtattttaacattataaattttcactgatttatactgattttttcaattaatccaaattgtggaagcttttctttcttcactaatccttcagtcctccaggctctgttagttgagataataattagaagtttagtgaaaaaaatgttcacacaagaatagtgtaaaggttaagatgtttgcatcacagcttggagcatgtctacctttcattttttagctctcgtctttccagttgatcatgtaagtagatttaaactccgtcagtggttccttatcttaagtgcacattaaaagcctcctttgaaaatagtaatttctcactcccacctctagatatttgtctaggatgtgtgtcgtagtccgtttgtgctgctatcaaagtgacaaaataccagagactgaatagcttataaacagcagaaattcctcacagttctaatagctgggaagtccaagattgaggtgccaggagattctctacctaatgaaggcccacttcctgattcatagatcacaccttcttgctgtattctcacatggtgaaagggacaaggtagctagctctctgggacctcttttgtaagggcgctagtcactttcatgaggggcttgccctcatggcctaattacctaccaatggctccaacttgtaatactatcacattggtgattatgaatttggagggacacaaacattcagaccacagtaatggactagaaattaaacttaaaaagctttctaggtggttttaatgtgcaaccagcttgaggatgactgcacgagagaaaaacaaaattcacgataacttggaataactgaacaaacacattttgacaagtttttaaatccagcagccaaatcttattatcctctagtgatttacaattcacttcatcttttaaatataaaaatatttaaacccaccctgatcttgtgacatgagcaagggagatgatagtatattcattttacagaaaagaaggctaagaatttatatcaattttgtaaacttaattaggtacttaagtaattttatgaagatttatttattatttatcagtaacatatatgttgctaaacactggactgggagatttccatttcataacatgaaggtgatacattcaatttcatagcattaggatgctttcctttttatacacaaacttgaccctcaatggatacaaaccatagcttatgttttcctattttttgtaaccagtattagttttaaaacatttcaggcacagtttgcatttatcatccttgtttattttgactcattcatcacattcatgatgtttacagtactttcctaactttggggccattattaagctgagaagtgacattaaccttcccagagagaattgtcgacacaggaaagctgacagcctgatcttctaatatgaaatcacaggtttgaaaggtgaggaaattgaccttgaaatcttccctttgccatctactggactctgagcagtcaaagtcattctgactgaagggcaagctgggccgtttgctctttgccttttattacactttttgtggcagaccaaacctccattagaagactattgaaaaatgccataagcacagctgcaagaaagatttctttgtgtttgcacatcagcacagtagcttctgggcttatttgaatgccatggtgagcgcttttataaggcagcctcacatctttagaacaaacgtgtggtggagttggaatttgaactcaaagttactgactgccagacttgtgctcagatcagcaggttctgcaactacccagctgttttgttcttgtagaattgggctgagcagcaaagaaaaagagagcatagcttatgaaataacatgattggttcaccaagtgcaaatatgtggatcaggagcttgatgcttctgccaataataaatgaataagagaagactcatcagtggccattttaataaatacattaatgaaagaatggaaatgtggaaagaatatagtggaatacgtattcaagcaggttttttccagatggtcaaatggtaggacaagagattttcagaagtcacagctgagaactttagaatactgaatactaaataactttagaactgtaggaatactgcttggagagaaatgaaaactatttcccaaaggagaattttgtaggctgtacctttgtttcattcgcttcttctagcatgggcaggtccttgcagaaaggactgagactggctttatcagggtcttattaatttctgtatctactgcaagtataaccagatatcatttgttaaaaatgggttccaattcaacagattctcttataatatgggcatcattatcctctcccattttatcagtgttgcatatcatttttacaattgttggtaatcttacacccataaaacatgaaattaattaaacaaaaactacttctttcgagtattaaacaaacaacaactgcactttaaaaaataagctttctgctctatccatgttgctgcaaaggacatgatcttgttcctttttatggctgtgtagtattccacggtgtataggtaccacattttctttatccagtctctcattgataggcacacgggttgattccatgtctttgctattgtgaatactactgcaatgaacatacacatgcaggtatctttataatagaatgatttatattcctttgggtatatacccagtaatgggattgatgggtcaaatagtatttctgtttctagatctttgaggaatcaccacactgtcttttacaatggttgaactactttacatacccaccaacagtgtaaaaccgttcttttttctccccaacctcgccagcattaccattatccttaggaagctaacgcaagaagcaaaaaccaaacaccgcatgttttcacttataagtgggagctgaacgattgaacgatgggaacacatagacatgtggtggggaacaacacacagtggggactgttgtgggggtgaggcaaggaagagcatcaggaataatagctaatggaagctgggcttaatacctaggtgatgggttgacctgtgtagcaaaccactgtggcacatgtttacctatgtaacagactgcacatcccgcacatgtatcctggaacttaaaagtcgatgaaaaaaattaaaataataaaacgaagccttctataattaaccctacaaattcaattgtttgaagcctccatcatgtcagggtacaggaggatctagtttttgacaggattgtctccccaaaatttggggacttcttagaggatgcttatgcattatacaaatctgttcttggtataatgttcaattctactcatgaaccaaacctcttctacaagtcttcttgtacaatttctgggtaagagatttcccttaggctagtatattatttgtatgtagaaacatactttccattaatttctttcagtgatagctgatatgaagctgaaatttaagtaaaaggttaatgaaatattagggataacataagaaaagtgttacagcttctatataatatatgtctatgtatgtgtgtatgtgtatgttgagtttgtggatgtgtacatacatacttcatttctcctctagtatttcagttccagctcctttatgccattctttcacccagatacctgctctgagggaatccatgttggtaataaggataacattctgaaggggagaagagagagggatagatggctacaaaacaaaaagaattgcactatttaaaagcagcccctcccacagactagcatttctttaaggtacatagtcacactgctttttgaaagagaacagtttcctcagtggcagttgaagacattgtttggatagaaattgtgtttttaacatgatctggcatatactggtaggatgccagtagaattgtggaaaactgcggctggaaaccattgtagagggcttgcagtgcaaactttctctatatggatgagaaaacagaggcacagaaagctacatgccttattttagacaactgagatagttagtagcccaaagaggcctagaagcctgagaaccactaagtcagggttattgacttagtcacctcttaagagggtgacttagtcaccctctttaaaatgtgtgagcaaatttgggcattgttgatttattgtaaaatggtatgccaaagcacaacctgttggtaaatagcataaaacccagggacatccttaaagaaaataataaaataatgttctttgatttctctttcattcctcttccttcccttctttcacattttatctcaaacgttgtggtacaggagcctatgctcacttttaggcccctgttctatacatactctgactagtgtcttagactcaagcgtactgttttggctttatcttaagatcataactttcccgttgctcttgatccaaaaatactgtatttgttttttgtaaatttattctggcattctgtactcttctcaagatagtgtgaaaatgtctaagtcattaaagacaagcaaatatgtaatgaattaccttccaggggcacagtgttataatataccagtgtgtcttaaaccttaatctccatgtaagtcactcaaagaccttatttactgggggaacctgcccccgatagtcacataggttcttttctattttccctaagtgtcagctggtctgagaaataaaaggaaagagtacaaaagagagaaattttaaagctgggtgtccgggggagacatcacatgtcggcaggttccgtgatgccccctgagccgtaaaaccaacaagttttattagtgattttcaaacggggagggagtgtatgaatagggtgtgggtcacagagatcacgtgcttcacaaggtaatagactatcacaacgcaaatggaggcagggcgagatcacaggaccacaggactggggcaaaattaaaattgctaatgaagtttcaggcactcattgtcattgataacatcttatcaggagacagggtttgagagcagacaactggtctgaccaaaatttattaggtgggaatttcctcgtcctaataagcctgggagcgctatgggagactggggcttatttcatccctacagctttgaccataaaagatggccaccccctgaagtggccattttagaggcctaccctcagggatgcattctctttctcaggggtgttccttgctgagaaaaagaattcagcgatatttctcccatttgcttttgaaagaagagaaatatggctttgttcctcccagctcaccagtggtcagagttaaggttatctctcttgttccctgaacattatcctgttatcctgttcttttttcaaggtgcccagatttcatattgttcaaacacacatgctctacaaacaatttgtgcagttaacgcaatcatcacagggtcctgaggcaacatacatcctcctcagcttatgaagatgacaggattaagagattaaagtaaagacaggcataggaaatcacaagggtattgattggagaagtgataagtgtccatgaaatcttcacaatttatgttcagagattgctgtaaagacacatgtaagaaataataaaagtattaatttggggaactaataaatgtccatgaaatcttcacaatttaggttcttctgccatggcttcagccagtctctccgttcggggttcctgacttcccgcaacacttattaaaatgcagattctgattcagcaagtctgggtgggctctgggattctgcatttctaagttgtttctcaggtgatgctgaagctcttggtacattgaccatactctgaacaataaggcaattgctataatagttaaaatacttgcatttcaaaagagggcatcaatattttgaactaaaaatgacaacatgagaatttcaagcagaagtgtttttgacaatctttgtatcactacatatagtcaggtggttattatatctctgtatcagatccatttgggaaagcccttttgagctcattatatggaagagtacagaagattggacaaatttttctttactgatgacaaatttcaaccataagctgatgatttattctcactcttctagtactttcctgtcttcctccttcctttacaaataaatttttagagcttcccgtgtacaagattctggttttgttttatctgccttccaaaggaaaaactttagaaatatttattgaatgttcattatttcttagttggtaggaacagtgggttctaattttaatttgggaggagattagttttctttctctttatccctctagcccccatggcaatctactcttctaacacatatcttgtactttatttttcttttttctctgtaattgtgttttcaaaaccagattcagcacttttctccttcctccaatgttttagaatgtgcctaccagtatggcttaattttgccccaacatctattatggtgctttgtatattaatatgcacaaataagtctcagtaaatgaatacacaataaatgttcatggtatttaattgacttggttctttagggcaactctcccccatgctggttttcaatgacatacggaaaatacctgtgggttatttgtttgcccctcctagatgctactgatgcaggtattctctgttatttatatatttaagtacttttcaattaggacagcaacacttttattcccatgcaaataatacccccttaatcctacaattcctacatgtgaagttgcaaatatcatctccttggcatgcctaatgtagaataatcttatgcacctgctttttctctttgggcattgtgtttggatgcaactaggaaaaatgagtaggtggttctgataattccttctaaatttgagcctcttctttgaatgaagtcgtggggaggatgtggataatgaaattgccaggccagaatagagatcttttgtgtgcttctaatctacgtgaaagacagcattcattctttataaatcttttattcctgctcaatacttattgagtaccagtatgttccaggcatagttagcagtagcatcccttccttcctggagtcaaattctatttgcgcatgtgtgtgtgcatgtgtatatgcacatgtgtgttttatgaagttaacaattaaatttagaacatagttcctattagggataaaaatagtgaaactataggaagcagattaggaggataaatgggagaaggaatagtatgggccttaaattttggcttttaggaaaggtttgtttaagaagacattcgagcagacacctgaggtgaagtaaggggtgagacatatgggcactggaaaaaaaggttccagacatggggagcagcaagtgcgaaacccctgggttgagaatgattctggaatgctggatgaaaagcaggaggcttatgtggcagatggagtaagtgaggtgagtgaagagatgagttcagacaggaggctagcctgtacctataagtggctgctcagtaaaaatcatgatactcttctgttttacaatttcagtggcttttattgctcttaggatgaagatgcaaaagcttgcatggcctgacctctacttaattctcaagcctcatcaggcatgctgtactctcccaagttctctgttccagcccccacactctcctgtggcttcttttggttcttctcttttactattcttgtcaccgcagggcctttgtatgtgccagtcccactgcctggagaactcttcacctacactcccaacctttgctcctttgcatctcagcttcattaccagttccttagagaaggcttccatggccttcctataatctctgttaggtgcactcatggtatcatgcaccctttcttcatgaaacttatcaacatttcagtgttgcttttctttatgtggttatttaattaatgtcttttcctgctgccaaattataagaggcacaaggctagaaaccatgagtattttttccaccacattatctctaacaccttgtatggtatctgtcacacagtagttgctcagtacatatttcaatagttgattacaaaaaaatgaactccctttttttcctgctttactttcaccttttatttctcttttcttttttttctctctgctctctttctttcttcctcaattctttcttcttttatcttactttctgaagactcttttaccgctgaatttgagattccatatggaagtgaacatttcctaatgactaaaggatgatgatagaaaggagttggtggcgtttaatagcatgctgccgttctatctgaaatcaaagatccccttcataagagagcatgactgttacatcttccttaaaatgaaaacctacatcaaacactgcagcaggggtacttttccatttcatttcttttgttctgcttgtggctttgctgaatccatctatcattaacatttataatttagcattgtcttctggcacagtgtgatgcgatctgtattgctgacagatgtgtctcagtcttggtcttaggtctttcagctgtctggtttctgggattttgcttatctaagcatttcatttgtcacactacctgccattgtcaacacgtttgtctttatcctcagtcattagtttcttatgctctgtcttaatcccattacagggtttgttcttgctatttttatttgtcacggtatctattttagtagcagatgtagttgtcagaacatctcctttgctcctgttattggtgtcacttgtgcattcagtgttagactttgtcttgtgtgctattctgggtctttctatgtacacttctttgtccacttcattgttttaatcatatcagatctttttttttctcccaggaatgcataattgtggttcatttatttcttcttgccgattctgaatatggtcgagttgctttgtctctgatgcaagcattttcggaaggccagatcaatggtgtaacagaagtgaatgcaaatttatgagtgtttggtctcaacatgtgtgcactcagtcagagaacagagcaagagtgtgtgcttttgattatgtgaggatagtatgttcacttataggcttgatttttactatgtgctcttcatatttgttttaatatagtctactggatgagaggtttatttttttttctcagtttagtgtatttctattgtcaacaacattttgaagtagaatacactttatctttcctacacttgggtgatggattaacaaagaaagcaaaagaagtttattctaaaacaaactgattgcttgaaaaaaaagctaattaagcaatggtttaacgaaaaaataaataaaagatgaggataaacatggaagggtacggataataaaaaacaaataggacttggcttgataatggtatacacaatattagcctcagaagtaaccatttaacatttacaattgattctcgcataacctaaaataacagagtacacgagggagcttcaacttactaaaagatagaagaaattctcttgcttgggaattggagatactctctcagaggaactagctatagcttttctaaggttttgatccaactcataattggtggaagaaaagagaatgtataaaaatgtctaaccctaggaatcctgtaattgcataaaatattttatgtccaatcaactgatttggaaccgtatcattctaagattcatattctccctctaccctgtgattttaacaattgcttttaagttgttgagttttaaatatttgaactgttttgttagtttgattcttctaaactgaggaaatcagaatattagtcgcttggaagaaaagacttaattttaattatggagtcccaggaatcaaggaatccaagagacagtagacgcttgaaacactggatttaaactgcctgtgaagctcttttcaccattaaagtgtaggaaaatagactttttaggggaaagagagatgttcattggagtttgggttttttgtgcctaatgacagccagcaatgcaaatttgaaagacgtctgtaaggctcttcaaatgaaaagaagagcacttccatatttatcctgtgaatgaataaaacacaagatcagtagctgtttaggctggagaatatttcatatatacatgttaatgtccatgcaaaaatctgcttgcatataccttatagcatcttcccactttgtacctctgtggtatttggtatatagctctaaggcttttcatggcatcatgattgtttgaatatcttctgtcacccttgttatgagctccttgggtcgattcactatttattaagccagtgctttgtgaattcttgttttttaatatataatttttaataaatggatgtcattctataatctatgccagataattaagcagtaaggttacatgctgtacatcattttccaacttaaagaatttatagccttagaatagggcagtgaaaaaaaggtccatgttgaaacattttcaggtaggcatacaatcactgtgtgtgtatgtaaaatacttgaaaatgtgggtaactgtgataaaaaagcaggtatctacaaaatactaaacatatgctccacattgtataaaacactatatgatacatatgacatctaatttactcatcataaaaatctagtgcagtaggtatttgtagtacttttttggtgagctgctggctcaaagtagtttccccttttctgggaaaaaaacttgcgagatcttgatgactacatttctaagttgaactttaaatttctggccatagcttgtggatccatggtttggatatgatccaagcagagattaatcagatttaatcttccaagatgtggaaatttgggaaagagacagagagactgggaatttttggagctgagtcatattaatgacagtcaatgggaaggtcacctgtattcattcactcaacaatatgtattaaatgccttgtgtgttccaggcaccaagcagggcctgggaattaaatgacagtaaaagtagacataatctatgttctcaaggaatttataggttactagaggggaaaacggtaataaaacactcataaaactaaaactataaactgatataaataaaaaaatggaatgtagttctatgataataaataataatagaatctaaaacaggcaaagattgggaagtagtaaaatttactttttttctacatttattgtttagaaagcacattacgtaagtggaagtgatacacgtggttgagagaagacatttcagggagaggaaacagcacgtcagaagccctagaatgcaagagggcagcgtggtgcagtattccagtgtgcctaaatactgagagctgggaaagagcagaaagttagtatggagagtcttgattgcctggttaaaaattattgttcgtattataagaataatgacattcaagagaaaggttttcatcaggggcctaatatgatcagatttgtgatcagatttagtccatgggaaagttgatgctagtttgctatggcaagagcaacagagtgggaaaagaagtgaatgggtttgataaatatttaaaaaataaatgtaatagaatttgatgataagatttatcaccagaaagagagagagagagaggtgtcaagtatgagatcaggtatgatttccagatatttgacttgaaaaggtagggatagataagttcaccaagttagataactttaagactcagagtgaattgattggtgttgaacaatgtaggattttatgtgcccatttgaggcagttgtgatggtcatggattttgtttctagcatatgtaaaggattacttatgttatttttgaagtttaaagtttggtaacagagaacttgcctagaaaaagatggtggtaaggatttcttaattttctagatcttcttgggaagaaattcatgaatcgtgaaggcactcaaagtgagtcagatcgccatctggtgactatttacagaaatagcagacacatgctccctgggtacatacttataactaacatttattgagaaattattaatgcctggaacctgtgctatacatttatatgtagcatcatatttaataacagattataacatactgaaatttaaagggtgatataaggtaatactattatatataaagaaagtatataattgaatggtacatgaataatttaaatgaaaaaagtattgagatgacaatgggatgatgaactgcacctcccctctctctgcttctgtcccccactgacatatgtacatgcacattcacattaactattttttcaggagaaaatttggaattaattctgctatagaatttggtctcttccctcctaaagaaaaaagagtcattgatagctcttgagttagctctttttaatgtaagccaggtttagaaaaaagtcaactttttttgcacaatacatccatttatctattcaacaattatagactgagcacctattatggtgaggctctgttctactgaagattcaacagtaaaaaaaatgtatgaaaactcctatcattatgaagtttcccagtgaggggagacagaaaatgacaaataaaatgtataatatgccacatagacttaagtgctaagggaaaaaaagcgcataaaggggataattacagatagtagaggtataggaatgttgatattttgagtggatattagattccatgtaacaaaaacttcaaggtgataaagaaacagaccctctggacattttgaggtagagtgtccacaaagaagagacagcaagtgcaaaggccccaaggttggaatgtgcctagattatttaagtaaaagaggcctatgtggctgtggtagagttagggaggggctgactgaaaggagaggaagttgaggataccaggaggagagttcatatttggtcttggagttcactttaagggctttgatttttttgcaaaatgaaatgagatcctgctcagcagaaatttacccttttcttgatatgagaatcagattttgttccttgaagagaatttcacatctgttttagagagatgggcttacttctcagattaccaacaagagacctactctatcttcttgctggtggaaaattgggagttggagtgttcaccttcttgcccactggcaccaccgcatttcatctcttccatctctatagccagacacagctcataaggggttgaattgtgagcctcattggagtttacccttaaagagggataggatgttggactaagagactcagaaggtaaggctgcgtgtagagaagaaaatgaaaagggctgggcattgtggctcatacatgtaatcccagcactttgggaggctgaggtgagtggttcacttgaggtcaggagtttgagaccagcgtggcaaatatgatgaaactctgtctctattaaaaatagaacagttagccaagtgtggtggcacacacctgtagtcccagctactcgggaggctgaggcagcagtgagctgagattgtgctactgcactccatcctgggtgacagagcaagactctgtctcaaaaaaaaaaaaaaaaaaattaaagagaaaaggaaacagagtgcctatagaggacacctttcttttcaagatctaagtgtaaaagcgccctcacttgtgtgattcagggggttatgttaaatactaagcttcctctcaggatggactacaattctgagcattcagccaagaaactcatatccaaccatggtggtcttgtgtgttttatctgggagaaactgccaaacaatggggcccaggaggactaactattctcttcagtcctcttatagatactcgagcagagataggactgttgtgggttggcttgtgcaccaccccacaaccccaaaataagtattttgaggtcctagcccccggaacacatgaatctgaccttacttgcaaatgggatgtttgcacatgtaataaagataaggtcatagtggattagggtgggccctgaatccaataactgatgtttttataagaagtccatataaatacacaaagacacaaagacacccagaggagaacaccaagtgaagatggagaaagattttagtgatgcatctacaagccaaggaccacccaggattgctggtgactatcagaagctaggagagaggcatggaacggattttcccttagaacctctgagaggaatcaaccctgctgacagtttgattccagacttctagcctctataatatgagagaataaatttcttttgtttcaaggtattcaatttgtggtactttgccatgacatccctaggaaactattacaaagaccaaaggggttttaaacccacaatatggatgtttatctgagaggtacagagaactatgaactgaaaaaatgggatataaaatccttaagcatgagagaaaatggaattcctgattgtactccatgggctaaaaatcaacaacctttaaggtagaaaatgaagcctcagtacattaaaatgtttagattgacgttagccgagagtatttcctgtctgatgtactgccagatgtatcagtatttataaactgaaagacagagggctggatatggttcataaatgcagctactcttgaaataatacacaatactattgggccagaaattctgcaacaattggcagaagcttggtgttggtctgtccactcctgagtgtagatcatatgcaatttccagctatcctgggtccccagtggatgcatatgcccttagacttgattcactctcttttgcgttacgagactcttctaggtaagttttgataaccagtaaacatgaatctcatttaatttattttactttttaaaacaaccctggaagcaagtattatattttctgttatttgtgaggaaattcagaggtcaaaagactgagtagcacagcagagatggcagaaactgaaaagaaagggcagaatttttaagcatggagagtacaaggaaggacattctgagcagaggggacaatgttcaagtaaagttacagaggagagaattgactgtctttgaggaggccccagctgtagcagacagaatctgttgggaactgaatcttgaactaaaacgtggaggactttgaatactatgtgaagaatttggattgaaattgtgggcaatgagaagccagaagtccatgtggcacttgtatgtatgtatgtttgtatgtatttgtgaatgtgcattcaattgtgtgatatgaaagagggaaaagagtggactgacacaaagattagaatttcactttaaggattactttggcagccatatatagaatagcttgagaaaaatacaatttatgaggctttcaaagtgtgagaaaagaggagagaatgatattttctcagaaattgcttactggagcagttagagagacaatctacatgaatgactggttttatttatgtgtgtgtgtgtgtgtgtgtgtgtaatatacacagtaatgaaacaaacagattattttgtaaatttggtgggcaaaagcagctgagttgtccaagtgtaaaactggattttgaaaaaattccacctgtaatgtataggtttccaatctagtctatctcttttaattttaataagtcaactgccaagtgacttctccagacactattgcttaccattagcttttgtttggccttggtagtaaagcattaaccaaaaatatggaaacatattttgggaagaactagtctccccttaatgtgatctcggtgaggtggtgtgtttattaatgtgttttcatactgctatacaaaactgccccagacagggtaatctgtaacggaaagaggtttaattgactcagttcagcatggcttgggaggcctcaggaaacttatactcatggtgaaaggtgaaggggaagcaaggtacctacttcacgaggtggcaggaaggagaagtgctgagcaaaagggaagagccccttataaaactatcagatcttgtgagaattcaatcactatcacaagaacagcatttgggaaaccatccctatgattcaattatctccgcctggtctctcccttgacccaggagaattatgggaattagaattcagaggagatttgggtggggaaacaaagcctaatcatataagtgtgttaattcaatgggcagttaccttctaccagtcccactaattactttgacaaacaaaatatggcaagatgatttttgaggtatattcaaaactagtattgtagttttgcttagcattctgctatagagtactaggaaaataacaaggaattgaaattatgtgtatttttttataaaaaatacatttttgttttattttatttatattttcccagctttactgaggtattgacagctaaatattgtatttgtttaaggtgcacaacatcatgttttgatatatgtaaacattgtgaagtgattacctcaatcaagctaattaacatatctattacctcacatgttatcttttgtctttttaataatagccaatctaacaggtgtgaggtgatatctcattgtggttttaatttgcatttccctgatggttaatgatgttgagcagctttttatatacctttgccatttgtatgtcttgtttagaaaaagtctatcgaggttcttttcctatttttaaatattattttccaatttggatgcccattttgttgttgttgttgaccaatttctctggctaggatttctagtactgtgttgaatacaagtggtgagagttgacctctttgtcttatttctgattttagagaaaaaaaattcaatccttcaccactgagtacagtttttagttatgtacctgacatacagagtactaatgatgttaaggtacattctttctactgttaacttattgggagtttttactttgaaaggatgttgtattatgtcaaattctttttcatcctctgttgagatggtcatatgtttttatctttcattgtgttaatgtggtgtttcacatttattgatttacatatattaaaccatccttgcatgataaacatggatgaaaaaattctgaaggaaatactagcaaatggaattcagtggcacattaaaagtattgtgcatcataatcaagtcaaatttatcccttcatgtgatttaatattttctttatgtattttagggttttgatattagatgcacatacatttatacttgctatgtcctctcgatatattaacccctttattatcatataatctttttttgtctcttgcggcaatttttttacttaaagtgtgtattgtctgatatcagaatagccactcctgctcttcttcagttatcatttgaattgcatgtctttttccaacccttcatttatattctatgtgtgtccttaaagctaaagtgaatctcttctaggaagcatatttttggatcatattttttaatgtattcgacaactccatatttgctgattgtagaatttaatccacttacttttaaaataattattggtaggtaagaagttactcttgctgtttttaaaattgtttcatgactgttttatagtactttttttgcttttttcctctcttgctgtttaattttgtgatttgaccatttttttgtggtggtgtgctttgattcgtttccctttatgttgtgcatatttttataggtttttaacttttggttaccatggggtttacatggaacatttaaaaaattagaacaatcaattttaagctgatatcttaattttgcttgcatataaaaactcttcatttttgctttttccccctgcccaatttatgtcattgatatcacaacttacaactttttatattctggatctattaacaaattattatagttatagttacgtttactacttttgtctttcaacttttataatatagttaaaattaatttatgcaccattattacagtagtagagtattctgtatttgattatatatgtacatttttgcgagttttatatttcatatctgttcatgctgcctattcgtttctttttatttcaggttaaagaacttcttttagcatgttttgtagggcaggtttagtggtgtcagttcattcaggctgttataacaagactaccataaaccaagtggcttataaaccacagaattttatttcttatagatttagaagtgaggaagccaaagatcaaggtgacagcacatttgtcattcagtgaggtcttgctttccacttcactgaaggcatcttcttgctatgttcttacttggtggaaggggcaaacaagctcccttgggccttttttattagtataaaagaactaatgtcatccttcagggctctgatctcatgacctaattgcttcccaaagtccctaatttttaataacaccccaatggagattagttttcaacatacaaattttcaagccatatgaacattagaccatagcaagtggtgatgaacgtcaatgaagtacttcattgtttgttgggaagcatttatcttttctttatttctgaaggacagctctgccttgtatagtactcttagttggtagtttttctcctgtaggacttcgaatgtatcattgctctccgcctacagagtttctactgggaaattcactgagatctcaggaaggtctcagttgtatgtaatgagtcacttttctgttgctgctttcaaaattccttaaatttttttttgacttttggcaatttgagtataataagtctcactgtagatctctttaaattcaacctagttgaggtccacttggcttcacgaatgtggatgtctattttgctccccagatttggaaatttttagccattattctcttaaataatcttcctccttatttccctttctcttctccttctgagactccaaagatgtgtatatgggttgcttgatggagtcacatgagtcccttagaccttcttcactatttttcattcttttttcttctctgactggataattccaaatgacctgtcttcacaatcactgattttctcatatgggtaatcaagactgctattgaattcctctagtaaatttttcagtgcaaattttgtattctttggttatggtatatctggttagtttttttaaaaatcatttctatatgtttttgtacccattttgttcacatactgttttcctggtttcacatagttttacatctctgttctcttgtaactcactaagctttttaaagatgattaattggaattcttaagaaattcacggatatccatctcttttgggttgtttattggaaatttgtcttaatttttgattatgttgtattttatagattcttcatgttctttgcatgtttgctttgttgtttgcacatttgacaaagcagctacctctcccagtctttatgaactggccttgactgtgagataccttcacttttcaggagtactttatatgagtcgtgatggagactaactccttgaggagtacactgtaaggctggggacagagtcccttccacaatctttcctcactcctagaggaaaagccttagtgccaatctcacagagaagtgctaactataaaaggatgtccatcccttttctttgttcctagctatcccagggaatcaagctctgctggctattttgtgatcaatatgaggcaagatagtaactggctctatagagggtgctctgaaatgttggggctaagcccccttcactttgttcctttcctcctggaggaaaaacctcaattttggacctattctaattcttacagtgcagctccagctataaggaaatgctttcctctttatttgttccaagctgtcccagattaccaagctttgccagttgttcaatacttgatatgaagtgagctagaaactagccccatggagtgtgctttgagataccaggaggacagttgtccaagtgcacattctaattccactttccccatgtgggaaaaatcatgagctgaggcaatattcttggcactgagataagccagtttaggggagggttgatgcaggtaaaatgaaattgttcttcttatctataaatgtgactgttttccaattatgttcctctgaggtacttctacttacctggatcctgaattggacttcaaggtgtttgttaccaatatcattgttatactggtatttctgtagaggaagaagagttagggctttctactctgccatcttgccgatgtcattcacccagacattttatttcagaacagttttagacttacagaaaaattgcaagaatagtacagatagtacttaggtgcccctgttattgacatctcatattcctatggtacatttgctaaaattgatgaaccaatgttaatatactattattaaataaggtctattattcagatattcttagtttttattgcatgtcctttctctgttccaggaatccttctgggagaacccattatatttagtcatcatgtttccttatactcctcttgattgtgacagtttctcagaacttccttatttctgatgaccttgacagttttgaagagtactggtaaaatattttatagaatgtgtctcaactggggtttttctaatagttagactagggttatgtgttttgaggaggaagatcagaaaggtaaactgtcattttcatcacatctatttatagtaatattctaaaaagctcattgctttttttctgttcattgcatgccatttttatgtttttttttttttttattgctccaaaacaaaggtatttacgcaattactaaaactctgaaagtttttttgctgcttcacagtgtggatgaatagttgataaatactttgagtgaagcctgactggtgtcctactgaaacacacgtggagtccctggcaaagaatgacctctatgatttttgaaatcttaagacgttagggatctaaaagctgccttttcaaagctacaagcagtttggagctttcagcactgaagcctgcaattgatcctgagtggaaagtaccataagccaatacctccatttcagaggttgagctatgaggttgggagtgcaaatgtggtatttatgagtttaattctcaggattctttctttctttctttctttcttttggtggaaaggaaaaaaaaggcttgttggctttttatgtatttagagtgcactcttccatatgcaaaccatgcttgtccaaatagagttgtggatgattttcatttgtcccaaattagtggaagatgagtacagataatgagtatgtcatttttagtggaagatgatgagaactgaaggttcaactcactcatgctgcagtgaaaactatagtaaaggaattggactatcaatgggctacatacagattataatagtgaataataaatattttagagcagagtgatgatggactatggtttgcatattatgattttgaagacataaactacacctataactaagtaatgggttggtagaaggtgaatagtatatttatctttaatcacgaatttatgagaagtcagattcctcatatcctatgcttcaaactcaggattccattaaaggctaataaaagaatttgagtattgccagccatgattcctgtctttagcagtcattcctgatgctcactagtgaccattggctggcccaatgagaaagggtagctcttgaatggtgttgaggtcaaacggtgtgttaagaaatttctcctctctttgtgtactttgaagcttggtttctgagattaaatgtaaccaaaacactgttagtggtggtggattagttggattcaatatgagaaacacaagagataggcaggatgactctcactaaaggaatcagaggactgtgaactgctacatataacatacagatctctaagttattcttgagctatactttttttttttgacagagtcttgctctgttgcccaggctggagtgcagtggcaatcttggctcactgcaacctctgcctcctgggttcaagcaattctcctgcctcagcctccctagtagctgggactacaggcacctgccaccatgccaggttaactttttgtattttagtagagacagagtttcaccatgttgcccacgctggtgtcgaactcctgagctcaggcaatctgcccaccttggcctccgaaagtgctaggattacaggcttgagccactgcacccagccaagctgtacttttttttttttttttaaagcttcaaaccttcaatatttcattaagagttacagtttggtttcagtcattctgaggaaaattaaggaaggggcttggcccatacctggtaaaagaatggaaggaaccaatttttaaccatttggaccagtgattctcaatgggagtgctttttgtcccccaggaaacatctggaaaggtataagagatatttctggttgtcacaatttgtgatgggggaaaaaagaactaccagtatcagggggatacaggcccggtatcaggtggatagaggcctggaatattgctaaacattctacagtgcaaagacagcctttcacatacagaactatctggtccaaaatgtcaatagtgctgaggttgaagaactcaatattttatatgttttcagggaatttctatgtgggcttgggaaagtttgaagtcaattgtcatttgtatatttaaagggatatattttatcattagtctataaattccagttgcaaagtagaggccctgcacatttgtgcacatatacacacaccagaaataaactctcttgcaattatcttctctatcattgacagggcaatgacctatgaaaattatgttatgtctaatagtccctcattgttatgtgcaaaacacccagcaaagctcaagttaaggttgtggtcacaaagaaaagagctatcattgctttatggtgttgtctgaagttaatgatttgctttgttttgaagcttacttttaaaaaattacttatcaagttatatctttatagtgcgttaagcctgggtggtttgtgttattattatacatgttgaattttagtgattgactgcagaatacaacgatgccatctcgggatcttctataaattggcaataaatattattgaaacagttttggaattagagaaaaaaacattctctagaataagaccttctaatgaaactcattcttccatcttgatcaacagcagaagtaaggtttttatttacatgaatggttactagaattgtagaagttagtctagtgctattaattatttgatcagttttacctatcaataagtttattcatttttatggtctaattttaaatgtattagaatagaaatgcaaccttatgttctgcttcaagttatgtgatgatagtaacagcaacgttagggaagtcatcgtgtaattatttagaaataaaaaagaaattttagagccaatacagatctctctttttttttttttctccctggcctgagatagcattttcagaaaaaaatagccccaaatgctatgactgttaaagtagtttggtaggccatattgcgactctcctggtggtaaagaagctgctgtcatgtgacaggtctcccatggataaccattacctcctgtcaatgagaaatgtgaagattaaaaacagtgtcaccaaacactgacatcatcctgcattttttatttaagagctgctgaaagatttcctgctggctgaccaaatatgtgaacagctggctcctgaccataatctgtcacttgcagcacatttcagactgcccatttaagagcaacataacatccttgggaccttcaagctagtcaaaggggcagaagaacttaaaaggaagcacaaagctagccaaaactatgagtaatccaaagaccattaagtggtttgtgagtattaagtatgataggtgaaggcaaatacttgagacattcaaactttttttctagtcatgggttataaatcctgagattggagttggtcattgggaatgtaaactcatatgagtgactaaagggaattatgtgattgctttgtattcaattttcaaaaacagtgtcctagatatgcttgcttatttatctaactgtctaagaacctatcatatctttaagacatttataaataaaaaagggaatgattgtttcattcttttcttatgaccacaaattaatcctactctcctcgatcaatcagcgatcagagtgccagtttggctgatatccgtataatagaaagtctcatttgaattgattgatcagctggataagttagataaaatgcagtctgcttttattcatcttcctgtttaataatgagctgtctggaacttccacttctttgatatatgttgtattctaataaaaagcaatcagctgcagaatttgctcaattctgttctctggattccctgataacacctaagttttcttgcttatcattatgctgttaaactactctctattgaatcaagaaggatataagctcctcttaaagtgaaattttccaaaatgttgagatttcattcacagccaaaataggagtgaccttctttggctgctttcccaaagtcaacctagaaaattgccatctacctggcacccaaaatgagactggaagggtagataagagctcatttatgaaaggccttgttttgccaagatacaatgcttggatccttgtctacgtgacagggagccagaaggttttaagaggggagtgatataattcatttcttgttggagtaaaaaattacactgataaaaccagaaaacagctatttgaagtagtcaattaaggattcctcagtgattgaaaatacattgtatctggaatcccatcccccaatttgtcagcagaatgaatatattaccacttcaaccatattatacactttcttccatcaataaataatatttgaatacagagcagaaaaatacatgggacgacaaatcttatcaaggtcttgtattaagtaaacaaactaacttttcatctttcactttattctacatctatttagttcactgtcactgatggaaaaaatctgctttttagaagggtgttaaggaatatagaaaggttgagtgagaaataaaaaatttgatatgataaaggaagaagtaaagtctctaatagatccgtattacatatatgtttatggcttacaataaagagttctgagacaattaaagtacctgaacatttgaaaatcttaatatttttccgtatttatcttgcccctccaacaagattgtaggattcttagaggcaaggccatgtttttgtatatgtttatccctcactgtgtgtagcattgtgcatgacacacagaagatattctgtaattacttggtgattgacaaattcttctttatttgtgattttttttagcactgacggtgaactagatgctgtggaggactgaaaatgatatacaatataaccactgcctcttaggtgttaaacttctcccaaatggagtagaactcagagaggcatatgtactttaaggtcacatagcatagtagtaatatctgtctctcttttctctataaagaaaatatgagaaatattcacaatagcaaatatttttgagagatcgttgtgaacctagtgaaatttttttatgccatatgcattgcatgcttacatttcatttaaaaatacagcacatcagtgtgcccacttaatatttgaggaaagaatttgtaataatatacgccccaaattggaaattctgtaagaatttgattatcttcaaaataaacgggatggatttttttatgttggtatgttgccattataccttcttcctctaccaagtcaactcaattcattgaaatatcccaaaggaacagttggaaagaaccttctaggggattggatgcaatttttctgaaacagaaggttccacatttaccatccagcaagaaaaggcaagaactctttgggcaactgctctctttgctgttgatgcaagctaagacatgctttgttgagtaaatcttgggaggatttcagatcctttttcaaactatgctggaatttttgcttccttttctaactatattggattgtgtaatgataacttttaaatgaatcattataatacagggacatgtcctacaaatttaataatggtcaccatgaagagcagtatgcaataaggtttcctcagcagggacatattctttctgaaagggaaatttaattatgtagcttgactactgtgtaattcaaaccctagctattgcagctcttttatagtacacaatggtcttagtggcagacagaagaacgacggttaccaccccatacgcaaactcagaaagctgaactgcccagtgtcttgcttttgctaaatttttgaattaatatacagctctttaggcattcctcccttataaaccatgtatgatagaagaaagccatggggattttaattatgtgttaattgtatgccattttctttttcttgcatttcgtcttccatcttttggtaaagtgagggagtcagaaatggaaaatatggagtcaaacaactttgcatgaagggaaacacaggatgactacaaaaactccctaccaatccccctgaagctattacaaaagtactttgggtgcctagaaaaaagtactatataaatccatggttcttgttattaccgtggaggtatactgtagcgtagttagcctgttgaaagggtagtgattccatggaagatgatgggatggaaataggaaggttggggaaaatattactggaataatagggagtgtccagtagatttattttaatatacactatttttgttgactttcctcagttgatgatagcaggaatagaatgaagaccttaagatgggtttgcccaatcaattgaaaactagttagcctggctttttgaaatccttagttgctatagtaaaggatgtgcatgagtctgttatttttctacacatgtagtattgaatagtagaaaaagcaataaacccaaagttgaaagatgtggattctagaactgctactcagatcctgctacttccgagctgtgtggctttagctctgatagataatatataaaatggggagatgaaaaggtagtttctgcctacctttgtaggtccttactgaggtgtcatgttgattctatgagatattaaatttgagaataatttattatgtataaagatctaagaaatatgtgacaatattgttattaactaaggagagaagagtgcttagtgtaaaattaaagccttgcgactctcaatccctgaagaatgcatacatattctgtgcctttttgctgagaaggggagagagtgctaatttatttaccttggcattttcttgtgcacaaatgtcacccctctccatccaaaaaatatgcttgctggcatttcttgtaaattgcttcttattctagctgctgaagtgagaccaaaggacatatatatatatatatatataagtttagactatttttgatatttttagtgttatataatcattgtacttttctgtataaagtaggtgacaaagcaggaagtagtttaacactcttggccccaggatctgagaaagctgcttcctaagtcttttgattgagacaatcttcatggccaatctacaatgctaactgattgtggcttttcctgcttaaaacctttcattagaaatcatcacctttagagaaaaaaatcacattatttacattgcatgctgctcacaattagaatcttcacctactaggcttacctcctgctttttacatcttaggcatcattaatcattttttatagttctctaagaaagtgttgccatttcatttatgccttagcacatgttcttttctttgctggatgcactctttctgctttgccctcatggaaaatacttgttttattttaagggaaagttcaagagtcacctagtctatgaaggagtattctatgaagtacacctactctatgaagtatacctactctgtggtgaactctactgtgctactccaaggcagagaggttatctgtctcttctctactacaaaaaacctcatacatgcttctgtgatagcactattactttgatcgggttgaagaagaatttcctaagtctgaggatgcaactaggagcaggtcttttcctttaattaaagagagaaagaacagagactcaaactgtgagagcaaaacagcaagctactttcacctcctatctctctacatgcagaggaaaggaagggtacatgctgatattgaacagagtgatattcaggcaagacagggacagctcttctattagcatattattgcaggtacaacagcaatagcaatgatataactgtgtgtcacactatgttaagttgctgtagggggagggctctttcctctctgggactgagtataattgtgactcttattggaatcacagaaggatttcagagatgggctacatgtgcatgtaggtaaaccagggattctgttcatatatatctatatctttctctatatatctatatctataatctatcatctatctatctatcatctatctatcaatcatctgtctaaacttcttatgaatgaagcatatcatttgtgcctaaattcaaattattttactctaattcaataatttttatttcattaatatatatactcagtaggcttcaattattatggattgggggaccatctggtgaacaaaggaaaaatccccttaaagtaaccttttctgatcttgaaggggaattttcccagaaacagctaccaataaaatggcatatcttcatttccagccggactgaatgtaccctttagtctagttcttaaactgcattttcgtgtagtgccacccctgatgacaatgctaattttctggtcaaggatgtttcatttgattcaagagttgggtttctttcaaatcccagaggactagggaatacttgtgggaaatcttttttttttttttttttttttttttgagacggagtctcgctgtcgcccaggctgaagtgcagtggcgcaatctcggctcactgcaggctccgccccctggggttcacgccattctcctgcctcagcctcccgagtagctgggactacaggcgcctgccaccttgcccggctaattttttgtatttttagtagagacagggtttcaccgtgttagccaggatggtctcgatctcctgacctcgtgatccgcccgcctcggcctcccaaagtgctgggattacaggcgtgagcggaaatcattttaatgtatcgaaagtcttgcacttcactgttgtgaagaaggccaggttagagcagggttaaatattctgcaatctagttgaatcatctcaaaactgaagcactctgagagaatgcagactccttttctgacctctcagcttttatatttcatcttggcaacaaagagttttactgagaatgaatacgtagttacacgcctcctgagtttctgtggtaaaactgaagaagtgagtgtatccaattgtttaaaataatgatggatttctacattaagcaatgacaagccccaaatggttttattttcatgtgaattattcaggttaaatctttcaatttcacctcctagagaaggtacactggaaaaagccctcccataatttaaccttgagcgctgagagcaatttaagtttcccttctgtaaccggttacctctctggttgaaaacaatatagctgtctgttgctgcttcacagaggtatatgattttgtacaaaggattcctctaattgactcaaaccctgattaaatgacccttagcccagtagtgcatactaaagaccacacatgttggcaagagaagataatgactatgccttaggccttttcctctctgtaagcatacttttcgagtaatcttatctgttttcataattttaattaccacccaatgaagatgactcccagataacactggcacctaggtgtctctctaacatcagacttttaatgtctattttcttgatattttcacctagctatactaccggaacccaatcttaatgtgtccgaaactgtactcaccatcttcccatgattgtctttcagtgagctctctctgttgggtttctttcttctatcagtaaatgggaccagcagccagctacttgcctatccagtcatgaagtgaaagcatccttcttccaaatattccttgccattatcaattccctcccagcctaactcttactttgcctgaattcgtcattattttttccatccctttgccctagttttttcaggccccctctgcatagaaggtgcttagtgaataaatgagtccaaatatttttccattattagaggctttaagctaattgctattttgcaagtattgggttttcttttcttttgcttttccccccaagacttggtattggtcataggtcctaacttgggtgcctttctaaggtggtcttactctagttcatgatccttggatttactgggaaaatgggcggccctcctaactaaattctacagttttttgcagggcctttaaaaaagtcagtcatgtgatcaatgctatcacctctaaacttgattttttttttttttgtaataaagttgtgttttcattttttggtaaatataggcatttaagttcatcttttatttttcacaattaatgctctgaattgtgtaacagaagaatatagcaaatagtggttttgtagttttatgtggcagtaaaccgtaccctgtcttgatctttgccccagttaacctcttttctattaatatgtatcacctagtctttaaatagacaggctttctaatccccagatggcaaaaaagaacccatttatctcacataattatgtacctactacttttgtaacaatagaattgattctctgatagaatgattgtatactgtgactacgtttagcttcaggtccagacttctaccaagagcaagaaaaggtttctgttgttcattgaaccaagtggagaattggttataagagtaaagtaacttatttttgatttccaatctacaaagaagagtttttcattcaaggcaaaagaaaatgatcaatgctaagggaaacaaatccacgctaagttaagttcaaattaagctctaatgcagcgctttatcagctcatatgtctgttagtgtgaaagtgatgcaagaataagaagttctaaattgtccttggtaatgtgctaatatacctactgttctattcctagtatttttgatttttaaaactgcgtattctcattaactcatagaatcccagatctattttccttattttgcattataaagagcaaaatttattaaaatatgtcatattagtaatatttgttattaaatactatccataaaaatagagtactttctagaaatttgaaattcttaatctatattatctatatttaccctctctactttttcttgcagtgattattggtataatttcaagctcttttgagtttctctacaacctcatcaataacaatacaaattttaacccagtctttccatacccattctcagattaagctagtatttttgttactactcattactatttttatagtaaaacaaccttaaggactatttcaaataaatagcaacctaacatagatttgaagtgtcaaaactgtgctcttgaaatgaagcccgactatttgcatttacaaagaggttactgcaaaagttgctagtagtcaacaaagaagtaaatttatacagttgttactcccagacataagtgcttctttattcttttctgggaatatttgcacatgccaaattattctcagtctttatcatttatatcatcaagaatattcagaatgccttatttcacatcacacacacacacacacacacacacacacacacaccccaaagatacatttttgggttaacaaagtgaacatacgttgatgattcctgttggcataagtaagtgttggatagatttaggtggaaatatatgtctttctaattcaaatatctaaaaatattttaaatgttttaaaaattgaagatggtatttaaaaagatagtgaccatatatttatttatatattttttattattactttaagttttagggtacatgtgcacaatgtgcaggttagactggattaagaaaatgtggcacatatacaccatggaatactatggagccataaaaaatgatgagttcatgtcctttgtagggacatggatgaagctggaaatcatcattctcagcaaactatctcaaggacaaaaaaccaaacactgcatgttctcactcataggtgggaattgaacaatgagaacacatggacacaggaaggggaacatcacacacaggggcctgttgtggggtggggggagggggagggatagcatttggagatatacctaatgttaaatgatgagttaccgggtgcagcacaccaacatggcagtaaccgtatatttaaaaaactacattcagcagaaatgctgcacaaaatttctttcattgctttgtggcattcatgtcttctcaatgtcaaggtcaggaggatttgtttctgttacgaggagatttctagaatccctcaaaattcgcttctgcaatatggctttgatttgggagcaaaacttcagaaagagaatgccatttcttttaaaacttaaaagtgtacttatgcttcaattaatgttaacaggatgagggggcgggtggtctacagaagataaagttttttaggtcaggcagattcttccttaaaaattattacaggccgggtgcagtggcttactcctgtaatcccagcactttgggaggccgaggtgggtgggtcatgaggtcaggagatcgagaacatcctggctaacacagtgaaaccccgtctctactaaaaaatacaaaaaattagctgggcgtggtggcggacgcctgtagtcccagctactctggaggctgaggcaggagaatggcgtgaacccaggaggcggagcttgcagtgagccaagattgctccactgcactccagcctggggccacagagcaagactccatctcaaaaaaaaaaaaaaaattattacaggtgtctatagcactgtaaagctttatacatatgaggtggtcaatacatatttgttatatatgaaataactaaataaagcaaaataaaataaagacatggagtgctttggacaagctgcttaactgctctggttctcagtgttatcatgcataaaaggtagataataatacggtctctgacttaagatggttccacttagatttgttgactttatgatggtgtcaaagtgatatgccttcagtagaaacagtactttaagtatccatacaaccactttgtttttcacttttagtgcaatagtcttatgttctaagactctcagtggatgcctgaaactgtggatagtaccacaccctatacatacttttttttttttttttttttcggagacagagtcttgctctgtcatccaggctggcgtgcagtggtgcaatctctgctcactgcaacctccaactccagggttcaagcaattctcctgccttagcctcccaagtagctgggactacaggcacatgacaccacacctggctaatttttttatttttagtagagacagggtttcgccatgttggccaggctggtttcaaactcctgacctcagatgatccacctgcctcagcctccgaaagtgctgggattacaggcatgagccaccatgccccgccactatgtttttttcttttttcttttttttaatctgacaactgggatgtctactaagtaactgatgggcaggtcgtgtacacagcgtggatgtactgaactaagggattattcaaatcttgagggggactgagcagcacagtttgaaatttgatcatgcttagaacagtgtgcaatttaaacttataaattgtttatttctggaattttccatttaatatgtttggactgtggttaacaatgggtacctgaaatcatggaaggggaaatcatagataaggggggaatattatatagtatttaataaattgcatgagctatacaacactttattataaaataagccttgtgttagatgattttgtccaactgtaggctaaggtaagtactctgagaacgtttaagctaggttaggctgaactgatattcagcaggttgggtgtgttaaatgaatttttgaatcatgatgttttcggtttatgatggatttattgaatcataactccattgtaagtcaaggaacagctctaggacttatcttagaagattattgtgaggattatattggacaatgcaggcaatacaacttggtaccgggccaagtacatagtatcctttgtataactttgtaccgtgccaaggacatagtaaatgctcaataaacattaattgttatgatgattttccttataatgaaggcaataattttataaatttcattagtgctttgactcatagtataatggggaaataatattttattgaatagttcagtgcttgttagcaaagattttctttagatataagaccagaaaaatttcatttgcttttacagatttctctgggattttagttagtattggttgccaaaatggcaactttgagtgttaatatattaagaatgtaattggattatttgtaactcaaaggatgaatgcttgaggggatggatgctgaattctccatgacgtgcttatttcacattgcatgcatgtatcaaaacagctcatgtgctcctaaaatatatacatgtactatgcacccacacaaatttacaaattaatcttaaaatttaaaaaacagctactactttgtagccatatcattactatgtgaagaagctacattgtttgttggatttcatttaaaactgccttgaaactcatgtatatgtcacccatggtgatgcatccttaaatttcctaaatgatttctttcatgaactttaacctacctcacctttctaaacaactgggaatatatcaaataaaatgagcattctacatgagattctaaacttattataattgagtttatattgcacatgacaaacatgaaatcaatcttttcataggcaactccaaattctctgccttcaaattgtcaatgtgttgagtcccttcaactcaaacatgcatttggaaggtcaggactgtgtcattagtcagcacttgaatctcagctaggttgcttatctcttatgtttcaagaacttatatatcatattgtctatgatggtttcaaaagtaacattataatccaagtagaagaatctgacaaacttctcttgttggctaagaaactggaaaaataaaaataatgtggtatattttccacagttaatttttataaaaatttgagatgtcttttctcatttctgatgtttaaatatccattataaaaataaaaagtggtgattgtggataatagtaattatcgtataccagcaaaataaaaagttggttaccccatgtgtgtccactaacattttgtttacttagctagctagagaataagttctaatgccccttaggattactcttttcattcagctctctaatgaccatctctttctatgatataattttctattatagctatgctacatttatattcctgtattatttgaattttattaaattctctctttcaataaatatatattgagtgtgcattctctctctctatagaccccatatatagagaccacatattatataatatatatatatataaatatagaccttatatagaaagaccatatatagagaccatatatatagaccatgtctacacagacacacatacacacacacacacacacacacacacacacacacacacacacacacattttatatatataaagagagggagacagaatgtaaatagcatggcactagtgcaatgactgggtgtttgattactgaacaacacgacatctagtttgacatagtttcccaattgaaccctttccactattacctttttaattttcttctattttctgctactctgttcaagtaaaacacagaaattattttgccaatatatagttgaaaggtatttagaaagctcagaaacaaatgtcaccatcagaattccaacagtatattttatgttcacccagaaagaaaacaaaagcaaagaaaaaactatccaaattagaaacgctgcagaagtataatgagtactgagtataatccttcagaagtattatggagtttgagttatttttcttaagaagaatgaagcccacacatcattgagttccagattttggggaaaagttctagcccactgcttttcggcacttgaatcggcttaaagggaattgtctgctgtgcttgatggtttggctgattccagaagctgctggatgttctgggctcaatggagtagaacatcataggctaaaactgattcatgatccacttagtggagaaggaaaaagtttttacctgggggagttatcatttcctctaacattgtgtcctggggtgtggcttgaaataatttcaaaaaacattcccaagtggaaacatttttctcatgtttccaggatagtgggtgatgtctttgtgtgaaaagctagtgccacagataaactgttaagttttagtttatcgtaacaacttcattctttgttttctgttaacccttatttaaaatgctctgaaatatggcttgtaagtctggaaaaatctctcccttttctccaagttattgacctaaaagtgaatttaagaagtctacaaaaatgcctttgatggcccagcgcggtggctcacacctgtaatcctagcacttgtggagaccgaggcaggcggactgcctgaagtcgggagttcgagaccagcctgggcaacatggtgaaacccccgtctctgttaaaatataaaagaaattagctgggcgtggcggcgtgcgcctgtagtcccagctactcaggaggctgaggcaggagaattgcttgaacttgggaggcggaggttgcagtgagccgagatcgcaccactgcactccagcactccagcctgggtgacagcgggactccgtctctacaaaataataataataataataataataataataataaatgcctttgacttttatagaatagaatattttgcaaaatgctttcatgtatgctatcttatttgataggatggaggtcccatgaaagagaaccagccaatggcatggcttctaaattacagatgagaaaactgagaccttaagaagtgacttgtcttcattggctcggctcttcagtgtaccaagctgagctctctgagtccacgttttagaccctttctgtgagaattcgttgcctctgacacttatattacttctttcatgtaaaatatttttctgcccctatgtattttacctacccatcttgacttgataatcaaagtgaaaataattgtaaggaaggcaaactttcttaattgttttctacatatgttgaaactttcttataggttcatttccgtagattgattatatttcaccttttaaatttcttttctgtgtttagagaaaaattgcagtgtatgaaagtcactgagagataattatctgcttgtaattgatggtaactgcttggaattttccagggagtatgtggattatggctggtcatcacattaaaatctgtctcatggggttccatcgtgctatttgaaaaacctgtgagaaatagtaagaaactattaagaaatttcaatgtaaaatgacccaagtggcttactatagattctgtctgatatttttcatttttaatatgaagactgggatttgtgatttaaattttatatagtaaaaatctgtctgcagaaaatgtaagctttattttccctattctttattgttatgcttcctcttttttattagagagttataataattagaatgcaaagaatctctttctccagaagacctttctgatgaataccagcaatttcattcttctgtccttgttcatagtttccatgatcacaaattatcttttgttttctagctaacatatttatactttgtgcattttttccacctgtccgccccaaaaccaactctccatttagatcctcatggatgtggccttgattttgtttccttaatagtcagtgtgacagaattttctgaattcttggtctgcaaagaatcagagtatactagtgaggatggtaaaattaaaatttattagacataccatagtgcagtgaaatataatacagtatcaaggaagtagacgaaatcctcagatactctacatttctctagcttagagattccatttctccctaggcagaattgttaaaatcaattttattgtgaatataatggacatatgaagaaatgcacaaaataaataatattggtatataaagtacatttatgtgaccactacctaggtgaagaaatagaacattgcaggaatcccagaaaatctctgcattacctatcccaactctgctgatttttatgttatccacatcctagcattcctttaaactttacctcacttgtgtagtctgtagtaaatgctgtcagtcttctattttgcctcttcacatctgctttactaaatgctgtggggtttgcatggcaaaaactcacagttgcccacttatctggagaattacccttggccaaatgggaatcactaccaggcatgtcatgcctcctctctccctgcagcctcagtattgactgtagcacattgactgtcccttaactcaaggtgggatgaactgtgtgatgctccaatgtttcaccttggaattgaaacaaagctgttttttaaatgagaccttactcttgcaggctttattgctcctctcttgataccgctcctccaagaaatgaatcaattgagcaagaacccatctcaggctctgattctaagatcacacgagattgtcaacaaaggagatagggatttggggagctaccttaaaaatctgtccatcacacatccttagccaactcagactagttttgcctattgaatacatattgaattttatatatttgagatcatacactatgtgcttattttgtctgttttttctcctctcattctttttcatgcgcatacccgattttctaaatatcactatggtatttttaagatttgtctgcattgctgcaggtggttgcaatttattcatttttatttctgtgtaataaaaaccaataagttattttttcattctatttttggacatcttgttggttttgattgtttccacttgttttgcgattgaaaactatactattatgaagataattatgtttttatcctgatgcacataacctcacttttgtatgaggcagtgcttcttaaagtttagcaagcataagaatcaccagatgggcttgttaaaacctagatttctgagacacagttctggggtttctgtcccagaatgtctgttacgggatttgcattctaacatcttcgtaggtgatactgatgctgctggtctggggtcctcacctgggagaaacactacggtagagtatattcctagttgtgaaactgttagctcaagagtctgcatatgttcagtttagtagttaatacctacaatttgccagagttataccacattgtgtatacctacagcgacatacaaaaattcttgttgctccatgttgtggtcagcactaattttcaaattcctaaattttaaatctagtaaaattgtattgatatcacagtgatttaaattcatatctctgtgattataaaaagactgagtatccattttatggcttgctttttcacacttagtggcatattttcaaaaagagtaatccttaattttagtatatccaaactttttctttcacattatgaaccatgatccacctaaaattgatttctgcatgtgttataaaattgagaatcaatttctttttgtttatatacctacttcattgccccaacatcatttatcaaaaagtattttctctgtcatagtcaggtgtcatttatatgtgaggtcctttcttggttctttagtctgatgatttgtctactctctttctctgccattctatcccacgatcttagttagttcagcttcattttaccacttacagtagttaatatagtagtatatttgtatttccggtgaacttaacagtttttcctcatgcaatgactatttctgtaataattctctttgccttaatatatattttgtttaatattactgtacttatgttagctttttctggtgtttaccttatcttttattttgtatcattttacatccaagatttatgtaaattccagtttcaaatgtgtacagttgacctatgaacaacagaggtttgaattacaaaactccacttatatgtagattttttttcaaccaaatatagataaaaatagagtattcacccaatgtgaaacccatgtacctggagggctaacttttcacatatgtgggttatgcagggctgactataaaacttgattacacacatatttatgtataagtaggtggtcctggaacaaatcccctgtatacagagtgacagttgtgtaaaagatttgtagctagtttttattttttaaaatcagtatatgaatcattgctttttaactggaacatttggttgatttacatttaatactattactgaaatatttgggtttaaattgattatatgatgatgtaaattggttatatgattataatcacttatgtgattagtaactattttacctgttctatattatgtttttcttgttgctgcatacaaagacgcacacatacaaacatacacacataaatcacacagagacatatatttaagagtttggaagttacaaactttttccctattcatgagtgttactctagagataatataggcacccttgatttacaaaaaattaataattatctttatctgagttcttctttccaaaaatgccagaatcttagaacacttgtgattcaattacccattttaatatatatgctattattctgtgttttaattctctctttatgtgaagtcttacaggacacttttgcttttgttttctatactcaaagtttatttatatttacaaaatgtgtactattttctttgctcatcatgccttcctgcatttctgagcttaaatctccacgaaagtggtaagaatggttattttattgtcgatacctgataattccaataactggattcccactgtgactctttctgttgtctgttgttcctcctggtttggcttgtcttgttttgcatctcttcttctttctttgttggatgttgtataaaaaaattacttctagaaataatttaaggcctaaaattgtgttgttttttgtttggaagatataataggagccaaagcagcaacagaattcactcgaaagggattaattgggttaagggactatttacaaactgttgttgggtaggaaataaacaagggcagttgaatcacccactcaagtggagaggctacccacctgtgaagctttagttatagacagatacaacctactgccagaactgtagcatgaaagcaggaatggggtgtggcacaaataccccaatttctttatactgccaccctcagatctcctcatcatgcttccctgtgtccaaaaccaaccagaagccagagtacatgggagtctggatgatgtagtcaattaggggtcagtgaacctaaagcaaagagcagagaagagaagggcagaaatatatagattaagtacagtggatatgtttttcttctaagctccttgctaaggccaaggcttgagtttctcttggacgcctcagtaacccattgggttatactccaacaactcattgtctaggtggatccctctagctcaggacccagagaggtggtgactcaccagagtgtgccatcttggtgggcactgtacttcacctgctgctcactgagtccgctgaaagcaaagcatgacctttcagctgcctccagtcaatctgtaaaatttccagggcagaagcagtgctcatctctaatgttctctgatctccacttggtgattactcattctctttgcttttactaggattttgcagagggatctaatgattttgtctgcagcaggaggattgaacagggattggcaaatgatagcccatggaccaaatctagcccaatgtttttataaataaagtgttattgaaaaaaaccacacctatttattaacatactttctatggctacattcatgaacaaccacaaggttgagtcgttgtgacagagatggtcttgtccacaaagtcttagtatttattatctagccctttgtggaaaaagtttgctgaatgctggtatacatgcccaccattattagaagccagctgtccctcctacaagacaatttaagatatgtataatttactcatgtgaagcatcttcatctgtaatagctaattaaattttagtggtaaacttgactgggttgaatttcttttccttattattacagatctatctaatcatggtgatattaatgagatgttcagcgttcaaactgaagttaattggaaggaaagtaagtagaaagaagtagtctaggttattggaaaaaaaaaactaatcaaactgccactgatagagataaacgtaaaactataactttaaagtgattaaaaatctgattaagtgacttaattaaatgtgcacacaagtaaatatgggctcgtaaccatttcaatactattttgataacatctagcacctacgatgtggctgatattgtgataggaatttttaagtgcatcatcctaatcaaattccagtcttcgttgagtttgttataatccttctcattttacagatgggtagactgacttccagaaagtttaagcaacttgagtgtgatcttgagcttgcaggtagcagtcttgggatttggatagactttagattaaaagcatcagaaggacaggaagaggccaattactgtacttccttagacaacttggctgtgtagcactgatagattttgttcatgttaaacatagtaacaattccatcactgactttttgtttcagttgtatactaggaaaaaaaaaatcaaatggcataggcagaaatatttccttctaagaaacagtaggaggaatctgattgatttggactaagggatcctgacaactcaacagtagccactgaaattgcctttctgactgaagtgtttaagcctggcctagagcgctgcagtcagcttgcacctgctgcatgaatcctttgctatgcttcagaatcaatgcaagtctttgaggtatattatgactctgttatgtatttattatgttcatgaatatcaaaggagtggaggacaagtctggaggcttcagacaaactacagataagctctgggaccatctaattgcatttttaaaagtggtattttatgtgtattctttataaaactttttttttttctaaatttctaggaggctatttgttccttaccctgaagttaacaactgggaagttttttgtctcttaaaattcaattgatttttaggtttgtattcctttctaacgtcctcagttgctttccaagcaagatatttgtacttaggacttatctaactttgacaaagatttgcccagagtctgagaccaagtgggaactaatttagccccagaaggaggacttcattttgactgaatggtaagtgatagaaaatggggttgttgcagaagtcttacagacttaactttagcagctgttaagtattgcaatagatttaaaatatttttgcttttaaaagtaattaagtaaaagatacataaataattctaagtaatgttgtatcagtaggtatgtgtatacattgtaatttgtctgaagtgaaaaataagccgagtgggttaccaaaccactagaatacttccagtgttacagtatttcatctttctttcctcattttctgcttcaccatcccaggtttctacttctcaatatattagtcatgaaaatatagaaatatagggaaggagagtatagaaaaggcagaaatatctcttaaacaaagcaaaagtttacttttttaacaaggaaaactatcaaatcatcactgggtaatcaattcatttggagattcaaagatgtaatctcaacatcatgtagcaggagaggttgacctctgtttttaataatgtatcttttaacaaacatacagtaaatgtactgtctctggaaggactaatgtacataaaagtattgtctaacaagcttaaaaatagaaaaatattttgagtgggttgttttcacgtctcttctgcaggacagatagaaaacaaggagacttctagagtatttttgatatgacaatgaaattgtcttacatgttcttaagggtggagaaaaaaattggaacaaagaacattaggacacataactttgtttacaataatctgttcagtttcaaaccctcttccagttaataactaccctagcacacaaagataccactaaccaagggtagctactatcctgacaattccatcatcatgtattagtttcacttactttggaaatgtatacacatggaatcacacagcatgtatcaactcttttgtgtctgcttccatgagattcatccatgtcatcatatttttagtacattctcatgtacttgtaatatttattgtgtgcctatactatacagtattaattttactgttgaaagatatttggtttctagggccatccctaggatatgtggaatcctgagaaaacttttttttgttatttgtattttggcagggtccctgtttgtacaaacaatttgattgaaatatattattaaaatgtatagacccataccaatatagaaatgtatcaataaccatttagagtagtaagtagaaaagaagtgcttatctatttgtttactatccaatcagtagtcatagagattcttcataatgtccaggtatctttctgttcaggtcgaggaaacaactctttattgtcaaaagccctgctcctggctaatttccttgtttctgctcctaggacaaggtaacaacactgttattattcaccatgccatcattctgcacaggctattggtattgaaacaatatagatcatcttacctttgcatttccctaatactttttattgcatgctcattatgcatgatatagcatcatctgttgaacatctgtgaataatggctcctaatgactctctcaaaggttgtgactttacttcattgagtatggccacatagaccagtcttagccatagtatgcaggaaaatgccaacaataatttattttctattcatgctaaatttactattcagaattttgttgaataaaaatataacaatgcatcttctgagtgagtttcttaatccttagttctagtttgattgcactgtggtctgagagacagtttgttataacttctgttttttacatttgctgaggagtgctttacttccaactatgtagtcaattttggaataagtgtgatgtggtgctgagaagaatgtatattctgttgatttggggtggagaattctgtagatgtctattaggtccgcttggtgcagagctgagttcagttcctggatatccttgttaactttctgtctcgttgatctctctaatgttgacagtggggtgttaaagtctcccattattattgtgtgggagtctaagtctctatgtaggtctctaaggacttgctttatgaatctgggtgctcctgtattgggtgcatatatatttaggatagttagctcttcttgttgaattgatccctttactattatgtagtggtcttctttgtttcttctgatctttgttggtttaaagtctgttttatcagagattaggattgcaacccctgctttttttctttccatttgctagaactcaggattaagaaattcactcaaaaccactcaactacatggaaactgaacaacctgctcctgaatgactactgggtacataacaaaatgaaggcagaaataaagatgttctttgaaaccaaagagaacaaagacacaacataccagaatctctgggacacatttaaagcagtgtgtagagggaaatttatagcactaaatgcccacaagaaaaagcagtaaagatctaaaattgacactctaacatcacaattaaaagaactagagaagcaagagcaaacacattcaaaagctagcagaaggcaagacataactaagatcagagcagaactgaaggagatagagacattaaaaaacccttcaaaaaatcaatgaatccaggagctggtgttttgaaaagatcaacaaaattgatagaccgctagcaagactaataaagaagaaaagagaaaaaatcaaatagacgcaataaaaaatgataaagggatatcaccaccaatcccacggaaatagaaactaccatcagagaataccataaacacatctacacaaataaactggaaaatctagaagaaatggataaattcctcgacacatacaacctcccaagactaaaccaggaagaagttgaatccctgaatagaccaataacaggttctgaaattgaggcaataattaatagcctaccaaccaaaaaaagtccaggaccagacagattcacagccgaattctactagaggtacaaggaagagctggtaacattccttctgaaactattccaatcaatagaaaaagagggaatcctccctaactcattttatgaggccagcatcatcctgataccaaagcctggcagagacacagcagaaaaagagaattttagaccaatacccctgatgaacatcgacacaaaaatcctcaatagaatactggcaaaacaaatccagtagcacatcaaaaagcttatccaccatgatcaagtgggcttcatccctgggatgctagttcaacatatgcatatcaataaacctaatccagcatataaacggaaccaaagacaaaaaccacatgattatctcaatagatgcagaaaaggcctttaacaaaattcaacagcccttcatgctaaaaactctcaataaattagataatgatgggatgtatctcaaaataataagagctatttatgacaaacccacagccaatatcatactgaatgggcaaaaactggaagcattccctttgaaaactgacacaagacagggatgccctctctcactactcctattcaacgtagtgttataagttctggccagggcaatcaggcaggagaaggaaataaagggtattcaactaggaaaagaggaagtcaaaatgtcactgtttgcagatgacatgattatatatttagaaaaccccatcatctcagcccaaaatctccttaagctgataagcaacttcagcaaagtctcaggatacaaaataaatgtgcaaaaatcacaagcattgttatacaccaataatagacaaacagagagccaaatcatgagtcaactcccattcacaattgcttcaaagagaataaaatacctaggaatccaacttacaagggatgtgaaggacctcttcaaggagaactacaaaccactgctcaacgaaataaaagaggaaacaaacaaatggaagaacattccatgttcatggataggaagaatcaatatcgtgaaaatggccatagtgcccaaggtaatatatagattaatgccatccccatcaagctaccaatgactttcttcacagaactggaaaaaattaaagttcatatggaacaaaaaaagagtctgcattgccaagtcaatcctaagccaaaagaaaaatgctggaggcatcacgctacctgacttcaaactatactacaaggctacagtcacctaaacagcatggtactggtaccaaaacagagacggagaccaatggaacagaacagagccctcagaaataataccacacatctacaaccatctgatctttgataaacctgacaaaaacaagaaacagggaaaggattccttatttaataaatggtgctgggaaaactggctagccatatgtagaaagctgaaactggatcccttccttacaccttatacaaaaattaattcaagatggattaaagacttaaatgttagacctaaaaccgtaaaaaccctagaagaaaacctagacaataccattcaggacataggcatgggcaaggacttcatgtctaaaacaccaaaagcaatggcaacaaaagccaaaattgacaaatgggatctaattaaacgaaagggcttctgcacagcaaaagaaactaccatcagagtgaacaggccacctacagaatgggagaaaatttttgcaatctactcatctgacaaagggctaatatccagaatctacaaagaactcaaataaatttacaagaaaagaacaaccccatcaaaaagtaggtgaaggatatgaacagacacttctcaaaagaagatatttatgcagccagcagacacatgaagaaatgctcatcatcactggccatcagagaaatgcaaatcaaaaccacaatgagataccatctccttgattgccagttagaatggcaatcattaaaaagtcaggaaacaaaaggtgctggagaggatgtggagaaataggaacacttttacactgttggtgggactgtaaactagttcaaccattgtggaagacagtgtggcgattcctcgaggatctagaactagaaataccatttgacccagccatcccattactgggtatatacccaaaggattataaaacatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctagaaaccatcattctgagcaaactatctcaaagacagaaaaccaaacaccgcatgttctcactcataggtgggaactgaacagtgagaacacttgtacacagggtacggaacatcacacactggggcctgttgtggtgtaggggagggggaaggatagcattaggagatacacctaatgtaaatgacaagttaatgggtgcagcacaccaacatggcacatgtatacatatgtaacaaacctgcacgttgtgctcatgtaccctagaacttaaaatataataaaaataatttaaaaaatgcatcttctaacgatgtctgctcttgaactattttgactataatcactgcaatagtaaaacctgatacgtttcagtgttgataatacccttgccttccatctctcaccagtagaaatgataggccagtatccatcaggagaacaagaggtggctccactcccacaaggaaagtccctgccttggtcagcaaagcttaaagccatccccagggagcattatgttgctccatctctcagaagcagcaaaaagcatagctcaagaggacccactggcattgcagagcatcaatgtggaggagataggaatggccagccccaaagaactggctaacatgggaggtacagtctgtggagagggtgagggattgcactgggtgctcatgcagaatatttgctgccaactccaccgttcttaggtactatagactggaggtggcactaaggtaagaacatggatgtatgagagtgggtgtaaaggcctacaaaggtagctcaacttcaagggttggcagtaattttttactaacctagctccctgtgtctatcttgtgtcacctaaaatcagtgtattagcaccattctggtgacttaatcttatataatactgtgcaaaaaaacattttaccaggtaaggtgacatagaccttcttggggtatctggttgatcctcacgagtgttgtagagggttggaaagcacccagaaggagggaaacaggaagcagaacccgtgtaagtcccagtcttggctcaggtgccccacactggtgacatggccactgccagttgatcccacttatggaaaggtgatagaaaattacaagggagatgctttatagcatggggtttttgaggcattgctaggtaaagccctatttgctagagtctaaggccagtactgttgggttgtctttagttttgtctgttatgagtaatgctactattaacattcttttggtgcacatgtgatctgattcctgttggccttatacctaggttagagttacttgattagacataaatgtacatgttcacatgtagtagatgctggcagttatctgggggtttgtatcaagtcattctcagtaacatgagagtactaattctccacatctttgtcaacatttggtgaggtcatgatcgttatttaaaaaaatagctcttctgatagatttagtggtacttaattgtgggtttcattcactttttcctggtgaataacgatgtagaatacattttcatttgcttgtcatcttgataccctcgttgatgaagtacatgttcaagtcatttttcaatttctgagcctactcaatacacttttttccaatagaaaaagtaagtctttttctaactgatttgtagaaatcttttccttattggtttgtagagattctcaggatatattctttgtctatacttttgtttgtattgcacatatctataacttgtgcacggcttcctttttcattctcttaatgatgtctttgagtcacaaaacttttcaatttcaatgaaatctaatttatcaacattttcctttattgttagtactttttactacttgaataatctttgtttaacccaagggtatgcatatattctgttttgttttgttctagatgttttattattttaattatttttgttgtttcagcatcctttactgaaaaaaaatattctttccctggcagcattattttggcatatgtatagaaacgcaagtgattgtataagtgtaagtgtgattctagaatctcttttttgttacaatagacctttttttaaaaaaaacaaaaaacaaacaacaaaaccttatgccagtaccataatgttttacttactatagctacataagaagtcttaattcttaggagtgtatgccctccaaatttatttttttcttaaatatttcttcactactcttggcctttctgatgtcctttataaccgtgtacatcaccaggatttcatctgggataaaattccttctgtctaaatagcttctgttagtttttgtttactgcatgtactctggctgttttattcaggctattctcagatttatctctctaaaaatatctttatgttgccatcatttatgaaggatatttttgttagatattgaattctagattggcaatattttaaaaaatagtttcaaattttttttcaaaaatttggttttgttttgttttttgctctcatcatttctgaagaaaagttagctcttggttttattatttgtcatttgaagataatcttatttttttccattttattttcacttctagatgcttttctaaacaaaatttttattttagagggtttttagatttacaaaattattgaaaacgtatacagataatttctatatatcctgcaccaagtttcacttactatgaacattttatattagtatggcacatagcttacaatttgtgaacctatattgatacattactattaactgaaatccacattttatgtagatttgcttattaaatccatcttttgaatcttaatcttagttattattgttcagttctagaacatgtatttgattccttttattggttctcattctcaggtgaatttaccaccttacatgcattttcttgatattttaatgatcattaattttaagtctctgtctcatatcttcggtctgtgttacccattgctccgtttctattttttgtttgtttgtttttgatcatatgatcttcagtctcagtatgtcttttgattgcatactggacattgtatctgaatacttagatgatgttatctttatccaaaaaaggattacattttatctcacagacagagcacgggccaattatcttacaagagtcaaatcctggtaacagcctttgttagggcagtctttccttcccttcccctctcttcccctcccttcccctccccttccctcccttcccctcccttcccttcccctcccctcccctcccctcccttcccctcccttcccctcccttcccctctcttcccctcctttcccctcccttcccttttttctttcctttctttctttttctttctttttttttttttttgagacaggctctggctctgtcacccaggctggagtgcagtgatgtgaccttggctgactgcaacctctgcctcccaggctcaagccatcctcccacctcagcctcctgagtagctgggactacaggtgcacaccaccacactcagctattttttgcattttttgtaaaggtgggtctcactttgttacccaggctggtcttaactcctgagctcaagctatctgcttgttgtggcctcccaaaatgttgggattagaagtgtggataactgtgcccagcctgtccttatttttattgggtagccctttaagaactggtttaaaatcctgcattgtttactagaaaccttcaccttggcagaccctgacgtcatctcgtcttcctagcaccacaagacttgacatatctggtcagcttttcagatttctagtcttcctttctacttgtgttcttggtgtcttgcatatgcagcttaagtgtcagctaatgtctcgtgggaccattttacatacaatttctaacttacttctatgtagttcctttctctctgagatcttggccctgcaagccttggcatctccaaactgtaacttccgcctccccaacctagttaaactgcctccagatcccagtactgctttctgcctctgttccttatgctgcaaattggcaaatgctccagggaaaaagcagaggtaaattaaagtttaaccacagtgagcttactttctgtctgtgatattgatcttttaagttctatactctttgtttgatttgatatcttcaagcaggtttttttgtatctattcaaaataaaatcagcttttattgttgatcttagagggaaggttaatctgatgcatgattgccaatcatactacaggtgcaatgaagtcataattattcttaaactaatattttgactattccatgtctggaagtttattggtcttagtcggtatctagtctcaacttgtttccatcttttgcctccgcctttccttctcttttctattttttgtattttgtcatttttctcatcctttggcaataacaaacttctctgcttgccttatgaggagtactgttgctcttttttttgaagctttgaactctgttgtcatcctaactggcaggatctgcttaacactccaagctcttaattttccaagtgcagacagttccctttttaagagaaattctaatctagttgctaagaaaaatttctcccactacttgaatccaatttctataagtgtatatatcagtttttatatacataatgcgtaattccaaagagaaattgaagtagcttcacagaaggaagtcgaagtttttaaccaaagtgtatttttgtatttatcttgctgtcaatttgaagagtaatattttatatattccagtatgttttaagatcttaaaaaatgtttaaaactttaaagtttccttgaagcttcttaaaatctaaggatatactcattgacttatgatggggttatgctctgataaactcattataagttgaaaatattgtaaataaaatgcatttaatatatctcacctaccacacatgatattttagtctagtctaccttaaatgtgctcagaacacttattagcttacagtggaacaaaatcatctaacataaatcctatttttataatgaagtgttgaatatttcatggagttcatttaatactgtactgtaagtgaaaaacagaatgattgtacggctatttgaagtacagttcctaccgaatgtatgtcactgttacaccatcaaaaagttgaaaaattgtaagttgaatcattgaatgtgaggaccatctacagacctattatctatctgtctatctatctatctaggtagctatctatctatctgtctatctaactatgtctacatgtgtggataggatgccctttaagtgttactatatatatacatatatatacatatatatatatatatacatacatatgtatatatatatatatatatgtatgtatatgtatatatatatgtatatatatgtatgtatatatgtatatatgtatatatgtatatatatgtatatatgtatatatatgtatatatatgtatatatatacacacacacacatatatatacacacacatatatatatacacacatatatatacacacatatatatacacatattatatatacacatatatatatacacacacatatatatacatacattcatgtaagtatataaatatgttttttaatttcaaaattaaattgcaaatgaagcattgatactatgaatattgccctcataagcctaaaaattcttccattttatttctttttgcccagtgctctggattcactttaagaacttatcatttaagctgaattttaatgtatatatgctgttcactcattcaggaaatatttattgagtggtaagtcagtgccagacattgtgcgaggtgctaagcatactgtggtgagcaaaatacagcgggtccctgtcctcatgaaacctacagttctgtgggaagactagatattaataaaatgacataaaaatacaaactatttaaaagtaaatgggcagcctctataaaagcatgtattcagggaaccaatattggccaggcattgctaaatgaaacctccatgttgtgttattaaaattttatcaaagattatgcatattgtctgtcatttccctgaataatcagcaaggtaaatgattttcagtcacagccgaataaaagatttgtttcaaatgtggtacagaatttctaatcaccacaagaccatgacattaataaaattccagtgcatagcagtcatcccacacacctacgtatggtatggataggatgccctttattttaagtattattctatttaatggcacatgtggatagtgtagggatagagaaaaagagagttatttgttatataatactaagtaaatttagttgttcagtgtactattgtaaaatttcattaatgctccaagttggtgctgataggtagaaggatggatgtgctagtatttataggacagatcacacttacttctagtacttgggcataaagttcactatatgtgcaaaactgatgaagattgaatacctcagaagagagtagcagccaaacacatttgtcacacaaattgtttctaattttgttcttgtggccttgccaagggaacaatataaacaagggaatggaggcataaatgtgtatagtatccttggcaaatgacaaacacacaaaatacagagaaatgtagaatgggttggaaaaaattgattatacccacatcatacattgaaggatgtctgatgttggagcaaagggaaagcccccccttctgccctctgaaggtttgctaaaatgaacaaacaacagagagattagcaagagaaaaggtacaagtttactgtgcataagaacaggagccacacaaaatatgagtgcattagtctgttctgatgctgctaataaagacatacctgtggctgggtaatttataaagaaaaatatgtttaatggactcacagttccacatggctggggaggcttcacaatcatggtggagggcaatagaggagcaaaggcatgtcttacatggcaggaggcaagagagcttgtgtatgggaactcctctttataaaaccatcagctctcataagacttattcactatcatgagaacagcatgagaaagacctgcccccatgattcaataacctcccactgggtccctcctacaacatgtgggatttataggagctaaaattcaagatgagatttggatggggacacagctaaaccatatcatcccatctctggcccctctcaaatctcatgtactcacatttcaaaaccaatcgtgccttcccaacaaccctcaaagtcttaactcatttcagcattaactcacaggcccacagcccaaagtatcacataagacaaggcaattcccttctgcctgtgagtctataaaatcaaaagcaagttagttacttcctaggtacaatgggggtatgggcattgggtagatacagctgtttcaaatcagagaaattggccaaaataaagaggctaaagaccccatgcaagtctgaaatccagcagggccatgaaatcttaaagctccaaaatgatctccctgactccaggtctcacattcaggtcatcgctgatgcaagagatgggctcccatcaccttgggcagcttccccatgtggctttgcagggtacagcccctctcctggcttatttcacgggctggcattgagtgtctgtggcttttccaggtgcatggtgcaagctgtcagtagatctaccattctggggtctgaaggttggtggccctcttctcacagctccactaggcagtgctccagtggggactctgtgtgggggctttcatattgccttagcagaggttctccatgagggatccgccctgcagcacacctctgcctggacatccaggtgtttccatccatcctctgaaatctaggcagaggttcctaaacctcaattcttgacttctgtgcagctgcaggcccagcaccacgtgtaaaccatcaagggttggggcttgtgccctctgaagcaatggtctgagctctacattggacccttttagccatggctaggatgcaggctaccaagtcccaagactgcacaaagcatcaaggctttgggccaggaccacgaatccattacttttctcccaggcttctaggcttgtgatgcgaggggctgctgtgaatacctctgacataccttagagacattttccccattgtctttgtgattaacatttggatcctcattacttatgcctatttctgcagctggcttgaattcctcatcagaaaatgggtttttcttttctatcacattgtcagcctgcaaattttctgaacttttatgttctgcttctcttctaaatataagttccaattccaaaccatatctttgtgaatacataaaactgaatgcttttaacagtacccaagtcacttcttgaatgctttgctgcttataaattttttccgccaggtgccctaaatcatcttgctcaagttcaaagatccacaagtctctagggcaagggcaaaaggccaccagtccctttgctaaaacttagcaagagtcacctttattccagttccaaacaagttcctcatctccatctgagatgagcagcatttggtcaaagccatttgacaaatatctaggcagttccaaattttcccacttcttcctgtcttcttctgagccctccaaactgttccaacctctgcctgttatccatttccaaagttgcttccacattttcgggtatctttacagcagcaacccactctaccagtaccaatttactgtgttagtctgctcttacactgctaataaagacatacctgagactgggtaatttataaaggaaagaggtttaattgacttacagttccacatgacggaggaggcctcacaatcatggtggaaggcaaaggaggagcaaaggcacctcttacatggcaacaggcaagagaggttgtgtagggggactcctctttataaaatcatcagatctcatgagactcattcactgtcatgagaatagcatgggacagacccatgcccgtgattcaattacctcccaccagatccctctcatgacacatgggaattatgggagctacaattcaggatgagatttgggtaggaacacagccaaaccatatcagtgagactcaaagaaaagccagagggctgaagcttaaatagcacactctttattaagggaaacacacgtaggggaatatagccaattttgaggagtagtaaatatttttgggggaattgaacaggctcaaagaacaaacaattgtttgcaaataattttctttggaaactgaatgggactgaaaagttacagaaatcttacggggagaactgcactgcggacaaaagctgtctctttatgtgcataaggactcttaggaaaactctcagagttgtctttagaatagattatgtctgtctgggcatgatgatgacttttagcctcatcccttctcttctttgatggttaaccattcctggctacttaatcagattcctagttggggaactttaagacaattgtattacttttggaagaagttatcctcagtcagatatggtagcttcctgaagaagcacttcccagggcttgtgagtggtggggagaagcaagagaaagttagaaagtccttggttctgaggcagcctctaaggtcttccaactttttaaaattcaaaagtgctcagcatgccaaagcactatactttgaggtattgttctctgagccctaacactggctaagaatcgaattggtagggactaagggagccactgaaatgtatatgtgaatgtgcatgtcagagaaaatatctgttattttgtaagattactctgtaaaccctgagaaaatggattgaaaataggacagctatggactgcaaaacttgttgaaatagatcgtagcaatctgagaaggcatgatactcaagaattccaaaaatatcacctttgattaaagaccatctctttgcttttttcactcttggaagaagttcaacaattgaggaatttaatgaatctgatagatttgaaagatacagattaaaaaaacctcaccttttggatgattggtctgtatttaataatttggggtttttaggtgatttcataatactttaagaattttatggtctgacttttctttttgactccctcaaaccatgctgcttcacaacttaagaattaatgtaaatatattaagaaatccccatctttgtcaattgctacagaaccctgcacagttctgatgtacactattttagaaaccgccctaattaaaatggaaacccattgtgtcagtatgtctgaaggagctagagtaatgtgcatttgaatgtttgtttgaatacagcttttaggctattgaaatttgagactgaggccaagcatagcagcgtgggcccagtgaaagaccaaagccaggcatgaatatttactgacaggcggttaagcaaaacagccactctgctgtttgtcttttcactgtcctgaatatttgcttcttattaatcttttaggacgtattcttcctttgctgaatccattattaaacatagaacagatactgtgttagcattgtttgttcttgctcaggttgacggaggaaaaatgtgttagatgtagttaaaagaagttgtattacttttttaattgtgtgaatttacaaatagaacaggtttctaataagataacctatatttccagttgtttttaggtgagaaaagtttgtatcttaacactagattgtaaaaaattgttctcacaaattctctaaagtctccctctgctttctgggagtatccatagaattttaaaagaaattatagagctcggtgtttgtgatataaaaactacactgaattttatgtttcatgggccagctaaggattgctcttctaggatgatttcaccatatttattttggttgtaattattgcctcataataataaaaaatcatatattggatcataaacattaagtatcaataggtctacaattctttttctttaacaatcttgcaatttgccaataaagtaactgagacctggggaatttaataacttgcccaatatcaactacctataagtaaaggcactgatatttacatttaagcctgtcttcaaagattctatgtttttctattttttctattttctatttttctattttttctaattcaccgtgctgcttcctcatagagataaatgtcataccaaattatttttcttcttctgagaagggaaggaggatgaggcatgaaggaggtacgactcaaaaacatgaagccataagcccttattgtaatagtaaatggcaaccaatcttccaatggcctgctgattaatgtctcaaaataaaaaatcagatctggtgatagcaaattcttggcaactaacatgaaaaaagcaaaacacaaaacaatttgaagtgggattctattgttacttctacatgggagatttatacttttgtctctttgttttcccaaagtgttagcttcagacaaaccaaaactccacttcagtttgacctgaatgtgttgggggaagccttgtaacttactgcctgatgggtgatgtcatggtgagtggcatgaacatggatggagtcagtgatcccaaacttcccaaagcttggtttgtatttcaagaatgtagatgtctatccaaaaggaaagacgcattcattggcaagtgagaaaatgtaggcattttaaaagtcgatattattaaattgtgcaattggagctacatcagggcttaacagctaaccaactctctactgtttggaacctgtttttgtctgaatcccaagctgaaaattctaatatgtagactagaatagcattgtggaaaagccttaattgtaaaactggaataaaagagcttatattttttaggagaatacaaagatagtcttttaaaaatgtactttatagtttgacaatttatggcaatttctgaaagggaaattggcctcaatacttcatttcaggtttcagcctctaactatgtgacaggatagggtatcctcacaataggatgccattttctccacatctcacttggggaaaattcatccacttatgtttccttctggaatctcttttgtccctgaagtcaaattcatgaatagctcagcttaatctcagtggacccaacacttctgttattgtagaatgttagtgtgatagaaattaattatgtaattcataagaaattattagccattttatccttctattacaggtgaactggggctacagcaggcctgtaaaaattcagtactccctgaggctgatgggaatggctactggatgtggttctgctgtggtaaaccttcgtctgggtagatattggaacttgaatagcccaatgtcaatgtatgtggaggcaacatgtccattagcattatttataaaattccatgactgctgacaaatgctgcctccactgctgaggttctgagagtttcagaaccccctcatgaaatatcaaaaaataatcacaacatccgctagggcccattggcaatagaattctaggtaaggcctctttagcagcttctcatcaagactaatagcaacccttgtgctctgtaaccataatgatgtttgttcctggcaccctacactgcccctgcctaccatttcccatgactccacacttctagtatcatgccctcttcagcttcctctcacacctgagattcttagttgctcccacactctactttccttcagagtggatcgtgcatttgtaccactgccctgcctggcactctctccactgatcttaggatcaccattatttattttttcttttaagctgcttggaaaatatttccctttagctcatttcacaggatctatgagctcttaataatgcagctgatttaattttgttactcagtttttttcaaatacgattgtttctatggtgtggctctcacctgtcaaagatatataagcagctgaagagaggatagggaaagaagtttgttttaacttcaagcataattttacctggcttctggctcaaagccctgctaagacctggtgagtctcattctttacctctcagttgctgccccttcaggtgctgtgttgcctccctgaacttgactgactgccactggcatcctttctcagtcaggctctcagtcctgtctccatttgatctataattgtgagtaggacttgggactttccctaagaagtttgtttctttggaaaactttaggagatatctagttgtctgattaaatttatttcaggattctgtgatagattttttaaaaaaaaatctttaaaagtgttttattttagaatagttttagatttactaaaagttgcaaaatatagtacataattctcttacacttctcacccagtttccccattgttaaaatctcatattgctatagcacatttttcacaactaaggaaccagtttggtacactgctattaactaaactcaatgctttattcagattttgctatttctattattcttttatttatttacttttttgagacagggtcttgttctgacaggtgaggttggttcactgcaacctctgcctcctgggctcaagtgatcctcccacctcagcttcccaaatagctgggactacagatgtgtaccactatacttggctaattttttataaagatggggtctccctatttttcccagtttggccttgaactcctgggctcaagcaatcctcctgccttggctttccaaagtgctgagattacaggcatgagccaccggacccagactttgtgattacaggtgatctgggagatatttttgacaagagcataaaggatgtatgggagagtgttatccgttatatgttagactcagctctgctcctttcaaaacaacctatgacaattacttcttggttgacaattacattattttttaggtgtatcatgataaaatgacttgaaagagtgaccatcaagagcaaaaattgtgttttcatatagaagctctttgcatttttggaacaccaaaataagaggaaagattaaggtaacccaagtcttacatcttttgctgaaaactttgctgagaaaaagtgggcttgggcaactactcctggtactctgcctcccctggggctgtagagcaaggtttctgacttcaggcaaaactatagtgactaggaaagcagtaggaatttaggtgagacttataaataagagagaagtcaaaaatcattttggaagctggagaataactacttgaaaatatacaaagctattaaaatccccaaggaaatttgggttggtcattaaagaaacattcttatatatattctgtaccttcttcaaataaaaaaatctgtatagatgttctgaagatgctgtgtgtgtgtgtgtgtgtgtgtgtgtgtgtgtgtctgagtgtgtttgagctggcaggatgacattcattaagcaaataaatatcgagtacctacttgtgtaccactatgttaattactggggatactgaataaataagactctgctcttgccttcaagaaggttatggcatgggtggtggtgatcttacacataacctagcagtttttcttagctttctcttccttcaatttttattctatgttatctgacatgaaaaaatgcatctagttatgggtaatatgaccattgtcattagcttgtcattatctgctaaaagaaaatacaagcatacatttttatcttcactaacaaatattgcttaagtttttgctctctgttgcacatttgccagccattaggcaaatagaaatactttaaggcataccgtatcccttttctagcttgtcaccaaaggtattgtcctaaataagaaaacagtgatgcaaggtggccttagttccaaagaatgttacagatttaaattcttcagcagattaagagagcagacaatcatttatactggaactggcaggcaaggttttatggaggtaagcctcagactatgctgagaaataaagccctacatgtgtacaaaatttttaaggattgaactagaccagccaagtttataaaatacgctttttcccttttcttcagtgttgctcattttctttcatttcttgccttctttatgtcatgatgactgcgttatagtgaaccattgttcatttctcattagttgcattaggataagggttaagatggattaagatgggcaccagcagccatgccaccctgagagtaattaaatgtaacacagcaagtataaaaattatcctggttgcttcaagtctctgagatttgattcaggccttgaacttgccctgtaccaatgattaactaactaatcatctggatattgtgccacaagatgtcctttcagcctgatgcctagttcatggtggaaatttacactcatgctccactttttcttggtgtccccaaatgttgttttacctgaaagatataattgggacaatttatgtcataattctataataatatttcaagtttaattttctaatagcctttgtcacatgtatttttatttttaaagtatggatggcacatgaattatgctatagtcatacacacacatacacacattcattcatatatatgtatgtatatgtgtgtgtgtgtatatatatacatatatatacacatatatgtgtgtgtatatatatacattttataccccacaaagaggtgaattctttaaaggaaatgaaaataaaaatttcacagggtgtagggcagagcaaatgctcatcacagactcatctgacaagtctctttcaaggtcctgtccgcacattgaagattcactctttgctcaatttgcatccttggcccaataaatgttttatgacctccctctatgagcactcacagccggaaggaggtaatgcaaaattgatctgtatattaaaactgctgagccaagcgggcttgctcctggaattacactgattatgtgtatgtgattcaacaggccctactgaaacaccgtagtatttgaaaaagatacccatcagctgcattttttatatacacagttttcttcttttcctcctccctttaaccctgggggccaactcccatattcacatctcttaactcccatttggactcatgaataaaaatacatgctttcaggagaaaagatgcttcactattatgctcagcagtctattatttctggagtacagtgaggagcatggaacttgaagtcaaacacacagtggttagaatcccagcttcaccatttatttgctacatggatttgggcaaattattatatctctctgggcctgatattactatttgaaagtgcagataatggcgttcaactgcctgacttgttacaatgtaactagtatgactaggttttgactatcagtgaatataaaataagacccatatcctttaatacccatgttatgatggtgtgaattaatactgccatgatagattcccctaaattgtgccccaattatttctggaaatgacactacattctctgttacatgcattaagaacagactcatttagtttcttcattctgttctctttggacaatctcccaaaatgtttcagttgcaactatttttatagagtgcctaatttgtgccaatatcttttctagcatgtgggttgtgtaataaataggatagatgaggtccctgttttcatcaagcttatagatggtggcaggtgggagtgtgatagttgagtaagatagataaataattatgtagaaggacaaatactctgaagaaaataaaacagcaatcctgtagaaattgactggcaacattagagatagtagtctggaaagtgttctctgaggaggtaacatttgagttaatacctaggtggtggagatggaactcactaagtgaagatcggaggtggatgaagaacatttcagattgaaggagcaacaagtgcaaaattctgagaaagatttactaacttagagcaaccgaggaaaggagagtatagctgaaatatagtgagaaagggataaggtgtacaagtgtagtctgagatttgtgcaagaaccttatgtttggccttgtagagcttcaaaggacaatcagactggaagatgttgacatgttttaaacaggtaatccacgtactttttgaaaatgatttatgaatatatgatgttctgaaattcagaaaaaaagtgtttcagtaagtcaagagtgtttgactatgtaacacacgactgcgaagtgaagcaaaaagagagacagaagagactgtaaatttggcaacatggagattattgacaaggtcttgataagagcttttcatttgagtctagagggtgaaaactcagttgaaatgagttgaagataggataggtgttgcagaagaggatatagacaactttttaaagtatatttggctgttgaggaaaataaagaaaagactttctgaaaggatatgataggtccagtaaaatttgttttttaatggcagatactagagactgtgtatttgtcaatattaataacccttgcagaagtatacatttatgattcaagagaaggagggaatcattgccagagtgaaatctttaagagggtatgagacaatatctctagaacacaggtgatttgcctggcatttgatgaaaaagggactaatatcctattgtagtagaaaagaaagcagggcatcttttgggaaattaaagacaatttcacctgattatttccactgtctcagtggagtacaaggtaaggttattatgtaagaggaaacatagagaaaaagaggttttgggggattatggagagaagagaaaatgtgaaagtcactgaggggagagggaatttgagcttacgaggaaatacaccagtctttccaagctagtatattttgcaaataaagtgaatttaaagtgagacctgctggtgaggtgggaggcctctacccctattgctgcaagacctcctaaaaacactgctcattaacaaaggctttgctgataattgctgctgctgctgctgctgctgctgctgctgctgctgctgctcctgctgctcctgctccagccatgagaagactatatataccctttgctgcttcattccaagaataaaacaagcactttattaagccacccatggagcaagaacaggctgcaactttaaacaaaatttaccgatgctttagatatggtagaagaaaataatggtgatataaataaattattttatgtaactactcttggaattcaatggagcattttttcatgcctataaatcaactggatgccatatggtagcaagggccaatttacttccccagagaatgcccttgaaagtgactgctctatgtccaagcaccaactatgccaaggatccatgaagatgaagttactccattctcatccatgtctacgatttgtcttctaactcccaattttctgtctccaggatcttcctcctcgcaagttgactcatagtagtaatttgcttttcatgggtgtgtttttatttctaatatacttctattgtggtaaaatacatataacttaaaatttaccatctttaccgtttttagcatactgtccagtggaattaaatacattcataacgttgtacaaacatcacctccatttgtatccatgattctttccatgttgtaaagccaagcctatattcattaaacaataacagctcattttctattcctccattccctggcaactatcattctattttctgtttctatcatgttgactgctgtaagtgtcaatcatactgtattttctttttgtgaccagcttattttgcttagcgtaatgtcctcaagattcatcaatgttgtagtttacgtcagcactttcaatctatttgggtatttggatctaaaatgagcctcttgtagacagtgtacagttggatcatgttagttcacctattctaatctctgtcttttgacagagttaaactcgtttgtatttagagtaatcactgacaagaagggatttatttctatcattttcctattgttttttatattattgcttttttatccttcattttctgcattttttttagtgtttagttgatttttagtggtgaaatgtttaaattcctttctcatttcctttggtgtatcttctatatgtagtttctctgtggttatcatgagtacgtgtaatattcaaaagttatactctaatttgaattaatatcagattaacttcaataacataaaactctgctctttcatgacttttccccattcctattgttgttcatgtcaaaaaatatatccctatacattgtgtaccctaaaatataatgtagtaattcttttaaatgcattaatctcttaaattatatagaaaacaaaatgtggaataacaaaccattgttataatgatactaattttaagagtaataattagttttaaaaaatgtatcactctcctaaataatgtagaaaacaaaaattaagttataaaccatgattaaaataatacttttgttattttccatgtacttacttttatttagatttttatttattcatattactttgacttgcagtctagtattctttcatttcacaaagcaaggcccccttaagcgtttcttgaaggacaggtctagtggtaacagactgtctcagcttttgttgatctgggaatgctttgctttttgaaggacaatttttgctagatgtagaattcttagttgacagatattttatttatttatttatttatttttagcaatgtgtctatattggctcattgccttcgggcttccaaagtttctgatgacaaatctgctgataatttcattgagaatcccttgtatgtgataaataatttcacttgctgctttcaatattccttctttgtctccagctatctcaagtttgattataatgtgtgtcagtgtggggctctttgcattcatcttaagtttattgtgtttcttgtatgtttatattcatgtctttcatcaaatttggtgttttcaagtttcaggcactatttctcatgttctctctaccctttctcatttttctccttctgggacttccacaatgtatatgttggtgggcttgatcgaatcccacaagtgtcttatactcttcactcttcaaaatttttttcttctgtttctcatactcagtaatttctattgttctattttcaagattgtcagttctttcttgtgactgcccaaaatctgtctttgaacacctcaagtgaaatttttatttcagttattgtatttttagctccaggatttcttatagatttaattttagagtttttctatatatctttgttgatatctctgttttgttgacacattgtcttcttgactttatccacatctttctgtagtttttgtgtatatgtaagactgttgttttaaagtctttgtctggtagatctgctatcagacctactagaacatcagggatagtttctgttgatttatttttttctttgaataggtcatattttcctgtgtatttttatgccctgtaattttttgttaaaaactggacatatgagtggtaatgtggtaactctggaaatcagattccctttcttcccaaggtttgctgagtttcatttttcgtttgtttgttttccagattgttgtaggttgcctctgtgcgaataatcaccttaaggtgaaaatttaaggttttctgaggtcttttctgagcctgaatttttccctggcatgcatggtcactttctaattttctttaaatgtgccattggttttgaaatgtccccgtgtttagcatatggatcccaaacggtaaaaaaggagaaagatggaaggggaatagaaaagggaccagtattttaaatctcctggaatttacttcaaccagaagttcaggggggagtggggaagcacttgcaacaatggaaagagtagcagcagcaatggccacccacttgtctgtctccacttctgtgatgaaaagtggcaatcagtgatcagagatttctgacatttggaggaaagggtgctttgtgtctggcctggctcccctaggtcatgtgcttgctgctctaggaacatgtgcacagctgcctgccacagggctgagggatgggggattggtaatagctaatatgctaagagctaaatgaactgaatttaactgcaatttatcgttctagctttctcatggatgtttcaagccttcaattgattccagagtttcaaaatagttacatcaggcaacttctgacagtgcctttattgccttggtgaagagataggttcctggtgctccccactctcccatcttcccaaaatcctctcaccaattcacctttgaagaaagtctatcttaagcaaaatgaatgtagtcttgctcaatgtctgactgagataataataatcagtaaattttggattattatcaatgtcacagtctgattatatactttttatgtcactacagtaccttgaggtaaaaaacatatctgtatattctttctatagatctctccatcacagctctttacacaccatctcagctgcttaagaacacaaataatttcaatgagcaacagtattttcttaatccactcccagtccaggaatacagtttgctgaaatacagtttttatgcagggcaatttacattgacaaattgaaatcatggcagtgaacattttacatttttttcacacaaatatgtgtcatagctttctatttgtagaattatggcttattcaagatgtttccccaatgacaacaacaacaaaagggaattgaggtctctccttccaatgatagataatcactctaagtttaaatggcagttctcataggtctccaaaaaaatcttcaagttgagttgcaatctaaggaaggaacttgcagaataattttaaattccacatatataatttgtctggaacgtgactaaaataaaataaagtcccagtttagtatattttaaattatatcccaagaagacatagacttttgttataagtgatcttatagtgttattatacctagatcataggtagatacctgggcaacatgtgtactttccacctatattattttcaaaatataaaaataaattattataatatatattactattaggtagtacaaaggcctaaatttgcattatggactgcatttctgcctctctattggcttattttctgaagtgtattgcctcaatgtattaaaaattgccatttggtacaagaagaattcatcttgaaaatttcccaatagatttatttgtacaattggtttaatttgaacttcagcatttatttaaattaataaattgtaatagtgaatttttatgacaccactttattaaaaataagacttaattgtggttaataatgtaattgtggtttgccacaattataattcaaacataaacatttagttaaatgtttacactggtgtgggtaaagttacagtaggagtaaggaaagagaataagagagaaagggagaaaaatgtatttacaatgaatggcagtgggaaaataaagcatacgatattgtcatgtgggttggtaactgtgatcaggaaaaaaaaaggaagatctcttaatgattagaaagaagatgaaattgcaaataatgcaccaaagctcagggctgcctaatacagaatagtagccatgaaatggaaagtgttggcctgctttaagaaacatcaatctttttgatattcatgcattgatttagtcattcatttactcatttatccatcaatttttaaatcatgtttagatgagagcactgaggaaaaattgtccaaattttgaaaaaaaggtggtgagataactatctggttttatgtctttccttttagagtcggctccgtatgtgaatagtaattacaattaattctgccacttcaaaaaaaaagatttttgtccttcacaacaaaaatctatattacctctcttctacttgatatatggctagtgtgaattgagatgtgctaagcgtaaaacacacacaggatttagaagtcttcataataataaaaatgtaaaatatcattaacatttatgttgattacatgttgaaatggtattctggatgtatagcattaaataaaatgtattattaaaactaattttactggtttctcctgcttgcttttactgtggttactagcagtttaaactttcaaatgcaataacacacataaccaatggaatagagtaagacagcccagaagcaaacctgtgcatatatggtcaactgatctacaacgagggtgccaagaatacacaatgggaaaataatggtctctttattaaataatattgggaaaattggatatcttcatgcaaaagaataatgttggatgattatctcacaccatacatataaatcgactcaatatggattaaaaacttaaatatacctgaaactgtaaaaatcctagaagaaaacacaggaaaaagattccagaaattgaccttgggaatgattttttgaatatgttactaaaagcacgggcaataaaatcataaatagacaagtgggattatatcaaaataaaaaactacttcacagccaaggaaacaacaaaatgaaaaggcaaactaggctaggcatggtggcttatgcatacaatcccagcattttgggaggctgaggtgggaggattgcttgagacctgaggccagaagtttgagaccagcctaggctacatagtgagacctcatctctactaaaaattaaaaaaaaaaattagccaggcatggcagtgcatgcctgtagtcctagttacttaggatcctccccacttcagcttggatcacttgtgccccggaggtcaaggctgcagtgagctgtaaacacactactgtaccattgtactccagcctgggtgatagagaccctttctaaaaacaacaacaacaacaacaaaaaaacaaagaaacagaaaacaaacaacaacaacaacaagaaaatacctacatagtgggagaaaatatttgcaaccaaatatttcataaggggttaatattcaaaacctataaggaactcccacaactcaattaaaaaaaaaacacacttaaaaaattgggcaaagaacatgtagaagcatttcttccaagaaaacatacaaatagccaagaggtatatgaaaagatgctgaacttcactatttatcagggaaatgcaaatcaaaaccataatgagatatcacctcacacctgttagcatggcttttgttaaaacccaaaatataacaaatgttggcaaggatacagagaaaagcgaaccctgtaacctgttggtgggaaattaaatttgtgtagctactatgaaaacagtgtgggttttcatagggtgaaacaggcggtgaccctgaaaactaacaatagaactatcatatgatccagcaatcctacttctggatatatatctaaagaaattaaaatcaggaccttgatgagatatgtgcactcccatgttcatggcaacattattcacaatagacaagatatggaagtaatctaaatgtccattagtcaatgggtggaaaaagaaaatgtacataaactcaatggactattattcggccttaaaaagaatgatatcctgcatttgtgacaatattgatgaacctggaggttcatattatgttattatataatgatcatgaaatcatattgtgttaagtgaaataagcctgacacagaatgacaaatattgtgttatacacttatatgatgaatgtaaaacagccaaactcatagaagtggagagtgaactagtggttgccaagagctggggactgaaagaagtaggtaggtattaggtaaaggatacaaagtttctgtcatacgagataaatcctagagatctactgtacaacgtagtgcctatggttaattatactgtattgtacagttaaacctttcctaagagagtagatctcatattcagtgtcatcatcatcatcatcatcaacatcatcatcatcatcgtcatcatcataaataagaaggcaggagaaagttttggaggtgatccatggatttatgacataaattacagtgatgatttcatgggtgtatactcattttcaaacttaccaagttgtatacattaattatatcagcttttggtctatctaaaaaattgaagctaatcaaaacatttatctttctactagaaaaaagttacaaatgcagctcagattatattgccattggacagaagtgctttacactcttctgcccccaaaataataattgtcggaattaatataggaaattaaaatacacataaatagatattacagaattatctttaatattataatttataatacatgattttatattatatttaaaatcactattttaatgtggctaactagcaattttacattatatttataatctacagtttataatatattataaatgtaatataaaattctgagatagaatcttcttttttaaaaaatttaatttaaagtcctgggatacatgtgcaggatgtgcagatttgttacataggtaaatgtgtgccatggtggtttgctgcacctatcaacccatcacctaagtgttaagccccacgtgtattagctattcatcctgatgttctccctccccgctttccccaacaggtcccagtgtgtgttattcccctccctgtgtccatgtgttctcattgttcagcttccgcttatatgtgagaacatgcggtgttgggttttctgttcctgcattagtttgctgaggttaatagcttccagctgcattcatgtccctacaaagggtatgatgtcatttttttatggctgcttagtactccatggtgtatatgtacacattttctttatccagtttatcattgatcggcttttgagttgattccatgtctttgctatcctaaatagtggttcaatgaacatatgcgtgcatgtatctttataatagaatgatttatactcctttgggtatataccctgtaatgggattgctgggttaaatggtgtttttggttctaggtctttgtggaattttcatagtgtcttctacaatggtttgaactaatttatattcccaccaacagtgtaaaaatgttcctatttctccacagccttgctagcatctgttgtttcctgacttagctattttttaaaatagccattctgactggcatgagatgctatctcattgtggttttgatttgcatttctctagtgattagtgatgttgagctttttttcatgtgttttttggccacataaaagtgtctgttcatgtcctttgcccattttttttctcgtaaatttgtttaagttccttgtagattctggatattagatctctgtcaaatggatagactgcaaacatttttctcctattctgtaggttgcctgttcattctgatgatagtttagtttgctgtgcaaagctctttagtttaattagatcccatttgtcaatttttgcttttgttgcaattgcttttgatgttctggtcatgaaatctttgcccacacctatgtcctgaatggtattgcctagattttcttctagggtttttatagttgtgggttttacatttaagtctttaatccattttgagttaatttttgtgtaaggtgtaatgaagtgttccagtttcagttttctgcatatggctagcgagttttctcaggactagttattaaatagcaatcctttctcaattgcttgtttttgtcaggtttgtcaaagataagatggctgtagtgtgcagtcttatttctgagttctctgtagaatcttatttcttacaaattttctcacattttttgtgtttttctttttgctcatcttttctactaaattgggcttataaatttgaaaaaaatagaacattcctccttacttttattttattacctacctctctgacatgtttcaaggtgttatatatagcactacatatgatagatcctgaggatctattgagaaaatatagttctataggtggatctctgtttcctagtgctaagttattttctatttattgtcatcccttgggcagcacaattctttctctgcctatgtcctctccctctgtgttgtactttatgtgtatgtgtactttggattttgtggagtttcagaatgtatgatatttaagaatgaaaacaacctcagttatcaaaaaataactccaaacaaaactccaaaatccattagctttactaaggaataagttatcagatagatactgtagggattgtgttaaatatcagccaagaatcttgttatgtttgaaataaagcagcatctaacactgttggcatgaatgaagctgacactttgatacaaaaactcactgactacaaatttaaatattaaagtataatgaagttgtaagtgtctgaaaaattgcttttcctcatgcacagtaggaattttcatcagcgtgaaattttgcagccatttctttgaaacactataaaagcttaattgacagttgtgtgattgggtgataattttttgatgttttatttactttttctatggattaaaatcttcccattattacaaaataattttcatgcatttattttttaaaaacatataaaatgcaaatcatattgctaaccccaaaaatgtaagctattagttgatttgtaaacatggaagtgtctgttaaatgtccaggaaagttaagattcttaccttctacttatgtattttatacaaaattatagtcccaatttataagtatttatgtttaaactatcaatatatgtacatatatgctaataatagtttataaaataaatggaaacatatctcatgattataatctttacttatttttatatttgtcaaattagaaattaatgttgagggttcacaaataaaatatatgtaaatttactacaaatacttacatttatatatgtttctgtattaatgaacaagtctttgcaggatactgtttcatcatttttcctaggataattactcataatacctaagctttgggataaatatatttacatttaatctattttttgtttaggtgaaatttgaaaatattagctgagtttttgttatatgcaaggtgcttctttttcttacttaatagaaccacggattttgatgttttattgtcgttatgttagaaagggtccttgtaaaatatttgaatgtgataggatatctacttactttcagaaagttcagaaagaaattagttttttgtactacatttatatttttttctgtgaatttgaaatggttaaaaaatagaagaaaagactgggcgtggtggctcacgtctgtaatcccagcactctgggaggctgaggtgggcagatcacgagatcaggagaccgagaacatcctggccaacgtggtgaaactctgcctctactaaaaatacaaaaagttagctgggtgtggtggcacgcacctgtagtcccagctacttgggaggctgagacaggataatcgcatgaacctgggagtcggaggttgcagggagccaagatcgtgccattgcactctagcctggtgacagaacaagactctgtttgaaaataaataaataaataaaaataaaaataaaaaatagaagagaaaaaagacttagttggtagctgagttggacaaatcacttcaactttgtgagcttggtgtctgcattagttctttcttgcactgctataaaggcatggatgagactgggtgatttataaagaaaagagatttcattggctcatagttctgtggctgtacaggcttctgcttctagggaagcccaggaaaggtacaatcgtggtggaagatgaaggggaagcaagcacgtctccatggcagaagcaggaggaagagagcaaaggtgaaatgctgcacatattcaaacaacaagatctcactagaactctatcacaaaaacagcaagggggaagtccacccccatgattcaatcacctctcaccaggcccctcccccaacactgaggattacaattcaacataaaatttggatggggagatagagaagaaccattccagtgtcccatgtgtaaactggcgatattaatacttaaggttattttaaaggatcaattataagtcaattataaactcatgattttccattttatttcatgggctgtaacttgtttttctcattatacaccactttgattttcaaattgtcccatatttgctagtagaaacccctttaaattgaaagcccagtttcttaatatccttgcaatactacagtttcaaaatttaaaagtatttaaattgttatcagtatatgcacatcaaggaaaagtatggtttagttaaggacattttcagatatctcaggatagatacccagagagtggttggcaagaacccaaactattctataactcctgaaggacattgttgcagaggatgcagcacctgcaggaggtgtctgtgatagtgagtggtggagaagcaacctaaagtgttgtttgctgtattcataagtggtaggcaggggtaaacctctgattaaaaaaaataatggtaaaagacattttcttacttgttttaacaagtattaattccaggaagaagaaatagcatggttagaaaaatagaattttaatatttttactcagattctcaggaagctgaagagatgaaattaacagaaggaaacatgcaggaaggcagggttgtaatttgcttctctttcctacctttaggcaaaatcagactcaagctattccagacacataatgttatttcttagtttaaagacttctagaaataggagatttcagaacttggtcaatattccatttcaatatgtagttatgcttactgcctgaaattctgtgtctcttaagttcaatactatgtacaatcttaagattaaaaactctgttctcattttgtactcaaagaaaacaaaatttctggctatattctcttcaaagtgtctataagagagtagttttaaaatttgtatttaccatgttcatttccacttccaaggggaagggacctaatattttctgaattcctattctctgccagatatacaactttactaacattttttgtcagtgccaagggctattatgggcattttatatgtttgaatttgtttggtttccagaactaccttctgtctgcagtttttttaataaaaatcacagaggttgggttaattccccacgtttacacagttttgtgtcaacttgactgggccatgggatgcccagatatttggtgagatattatttctgagtgtttataaggatgttggtagatgagatcgatattttaataggtggactgagtaaagaaaattgccctccctaacatagatggacctcatctaatccagcaaaggcctgaatagaataaaaggctgagtaaggatatatttgttctctctacctgaatgagctggaacatagatgttctgctggtttcagagttggccttagactggaacttgtatcactggctctcctgattcttggacttagacttggactgcaacttatgccattggctctcctgggtttggacttagcctgcataattttatcagccaaatttcttataatcatgttctcttcctttctctcttatgtttctctggagagccccaactaatacaactattaagaggtagagcttggagtccaggccatctgactctagcattcttgctcttaactaatatactaagctgtctctgatttgacaaacataacataattatcactacttggcaaagtcagtgggatttttttctctccattttatagaagaagaacctaagacttagaaagggtaagcattggttttgaggtttatttcgccaaagttgaggatgcacccaggaagaagaaaaacacaagttacagtgggttctgtgacctgtgctttgttctgagcagggttttgaggactgctctaaaggggaaaaagtgagcaggataggaaagacggggaaagggtggaggtggtaaggataggcaatgaggcaagtggtcacagtcttgtgaagctttgattagtgccctcttaatccacatctgacatgtgaaaggaggggacagaggaacagtcaattacgaattcatttggtactcggtaaatctacattttacataaggtaaagtaagcatgagaaattacagctatctgttcgataacaaaaggttgtctcagggattgggaagggagaatgtaagttcccaaatactcaggaagctatgtgcttggaggcaagggtctccaatgacctgagggcagcctgaagaagagtcatatgtatgggcaagttggaggcaaacatcagcactggggagaggtgtaccaaaacagcaaacggatctgagggaatggggcagagccatggtgcaatgaagggtacgcttcggatagagatccctctgatgccaacacctatgtactttttccattaccctattttgcctcctgtttcccttgcactagtcagcctcccactactcctggcattagcacccacagacctaagggctaagttaccctacagcttgggaacaaatgtcacttaaagcagtgagagaatcaatacacccagctccatttcctagaaggtctagtagccttctagatttataatcagagccaggggtttaagaaagtggttttgggccaggcgcagtggctgacgcctgtaatcccagcactttgggaggccgaggcgggtggatcacaaggtcgagttcgagaccagcctggccgacatggtgaaaccccatctccactaaaaatacaaaaaaattagctgggcatggtggtgcacacctgtagtcccagctactcgggaggctgaggcaggagaattgcttgaaccgggaaggcacaggtagtggtgagctgagatcgcaccactgcactccagcctgggcaacagagagagactccgtctcaaaaaaaaaaaaaaaaaaaaggaaaaaaaagaaagtggtttttacatattataatttataagattttttttaatttatttattattattatactttaagttttagggtacatgtgcacattgtgcaggttacatacgtatacatgtgccatgctggtgtgctgcacccactaactcgtcttttataaaactttattaaaaacatttaacacagtataaaaatgaaactaattccttaagaaactacccagatctctgtccttcagggcagtaatgcccctgtgtgcactttggaggcctattttccaggactttactgcatagcagctgctacctgggttacttgtgatcctgatagaagtgagtcccggaaaggtaagtgacctacagccgataagtaccaagtaccctgtggaattctgccatatgaatgcacaggacacaacagatgagatctctgaattttggttttctacctgaaagtctcccttatttttctctgacgagtcagatttattttcctctaagcttgaattatgtaaagatttgtggtcttgtgtaggctgcaatttgacaaacagagacaatagtgctaagcaaaggtgtgaagaacaactttacatttttacagcatttttcacaaccattgaatcctgatgcacttcacaggaagtagcaacaactttttctatagattctattaggatgtgaattttgatacccaattctgaccttctgaagttcatttaatggtgtgggaggctccaaaatggttatctttagactttttttcttttttgcattttttgaacgttttcctttgatgtttctacacatctctccaaatgaaagcaaatatttattcatctaatgatgtactaagcaataggggataaaatgccaaacaggaaatagttttgaattctacttttgccactctttttgtctaggttttttatctataaagtataaattatatatccccatctcaagggtaatatatgcacattgtgtttcttctacctcagtaaaacactgcatacaaggcccttagaacagtattttacagtcagtcaattattactgttaggaactgactatgtgattatcaggcactgtcccagggataattaaaattatactatgttactgacctcaaaaagcttacttctagtaggagacagatgtcatacagaaacagatataaaaatttgaaatactgataaaaaagaaaagaaaagatagttgattagaggtggggcaattttaactggagtggtcaaggatgaggtgacttctcaagttgggacctgaagaccaggaggaagccatgcaaaaacctggggttaagtcattccaagccagtagtgcaaatgccctgaggaaaggataagctgacctgtttaagacccagaaagaaggcacgtggactgaaggtgtggaatgagggtagactgaggttagaaaaagagcatagggaaacaagtggcactagatcacctaaggccttgtactcaatgggagggagtttgaattttattgtgactgctgtgcagagccacataatgcttttaagcaagttgggagttagtaattggatttatattggattggattgcatagccctaatttattattatgaataataaattcataataatgtattagtccattttcacactggcataaataactaccagagactgggtaatttattaaggaaagagatttaattgactcacagttctgcatggctggggaggcctcaggaaacttacaatcatggtggaaggcaaaggggaaacaaagcacctcttctcatggtggcagtagagaaagggagtgaagagggaactgccaaacacttttaaaccgtcagatatcatgagaacttactatcctgagaacagcatgagggaaactgcccccatgatccaatcacctcccacccggaccttcccaggacaattggagattacaatttgagatgaggtttgggtggggacacagaaccaatccatatcaaggacagcccataacagagttaagaatggaatcagagagaacagctgagcatttgcaatggtggtcaagataagagaagatgtttcttattggagtaaggtagggagtaatggttaaacctgatgtactttttgtggtagaatttgttaggctggatgtgggaggaaaatatgtcaagggtgacatgagttttggcttgagcaaaatgaatatgtggtggtgccattttctctgaggagaaaaaaacttggattgggccaacagttatgctttggtcatgctaaggataagatacttgttacacatcaaagcatgaagcagccaactaaacagttgactaattcacttagggagatttcaggaccgattgtatagccatgtctcagtatccacagggaattggttccaggacctcctgcaaaaaccacaatctgccaatgctcaaggtactttataaaatggcagagtatttgcatataacctatgcacattcttccatatactttagattacatatagttataatacctaatgcaatgtaaaggtgatgtaaatagttattactgtattgttttttaaaacctgtattttttattgttgtgtaatgtttcttcctaaatattttctatctgtaggtggctaaatctgtggctgtggaacccatatatatgaaaggctgactgtatattcttcaattagattactttcaaagtcataggttagtggaaatcctttaggaaaaatattatttttagcacctatagaagatcaggtgttccaagtgatatatatggttttaaaatttttaatacatgaattactaaacatttttaaatttaatactgcattttaaatttttcttgtatggcttataaccaccgcagaagatagaaaatgttattttgattttactgatggggactagaggtacagagacgttaaataacttgctcagttacatacttagtcgataaaaaagtcaaaatttgagcctaggtaatctgaccccaatttacagtccctggagtataaaggaaaaagagggactagaattcagctctaatgcaatttaacattttgaagtcacgtcacaggagctagagtctgtgagataactaagaagggacagtcaatgaggtgtgagagagtctaagtgaggatgagttgtacatgcctagaaaagtcattccagttaatgacctcccactaggctccacctccattaaagttaataaataagagattaatgtatcaaatgttgtaaaagcacctgctttggctgcatatacattcaatttaaaataatgcaatttattaagtaaatatagccaataattattatgtatttaaaatattcagtacagtactaaatatatttagatatttagataggctaaatatctgagtacatttaatttttacaaaaccctgatacatcaagttattcctactgtacagatgaggcaaccgaagcatacagtgctaagtccccaaggttgtacagttggtgagaggcagagctgggacccaacctaagcagtctgacagtagaaactatgctcttagccggcacaatttaccaagtctcttaaacatgatacaaatgtacagtccataaagcaaaatattaattaccttgagtacattcaattaaactctcttcatcaagagttatcataggaaaaaagagacaaatcacaaactggaagtataataacacatataaacaacaaatgactagtatctagaataaatatagaactcttaaaaggattaataagtgaaagacagccaggcacggtggctcatgcctataatcccagcaccttgggaggccaaggcaggcagatcacctgaggttgggagtttgagaccagtctgaccaacatggataaaccccatctttactaaaaatacaaatttagctgggcgtggtagcacatgcctgtaatcccagctactcaggaggctgaggcaggagaatcacttgaacccaggaggcggaggttgcggtgagctgagattgcaccattagactccagcctgggcaacaagagtgaaactccatctcaaaaaaaaaaaaaaatagtaaaagacaaagaattatccagaaaaatagagccaaagacatgatcaggtgtatttcacaaataaatgtaagttgtttatcaacttattaaaagatactcaatgattataaaaatgtcagttaaaataataagtaatcctttgatactcagcagattggcaaaggttagaatatcagacaatcataaacttggtgagaatacgaaacaattcacattgcttatggaaggcaagttggcataattacttaggaaaatattttagtattatcttgtaaaatggaagatgtttacaaggaaggcctcaggaatatcactgctaagtaattgatctagaaaaactcttgtgcacgtttaccagaagacatgtataacatgtttatagcagtgtgttaggtcattcttgcatggctgtgaaaaaatacctgagactgggcaatttttaagaaaagaggtttaattggctaatggttttgcaggctctacagaaagcatggcaccaacatctgcttggcttgtggtgaggcctcaggaagcttacaatcatggcagaagacaaaggggcagccgacatatcacatggctagagcaggagcaagagaaagagggagtgagggtgtgccacacaccctaaaacaaccagatctcaccagagctcaccatcataaggacagcaccaagacatgagggatctacccccatgatctgaacactttccaccaggcctcacctccaacactggagaccccatctcaacatgggatttggaggggacaaccaaactatatcatttcactccagccacatctcatgtccttctcacattgcaaagtacaaccatgccttcccaatagtcctccaaagtcttaactcattccaacatgaactcaagagtcccaaagaccaagtccaagtacaaagtctcatctggagatgagtcatttccacctatgagcctgtaaaatcaaaacaagttatttactcccaagatacaatgtgggtacaggcattggataaacattcccattccaaaagggagaaattggacaaaagaaaggggctataggccccatgcaagtctgaaaccctgcaaggaagtcatcaaatcttaaaactccaaaataatatcctttgaatttctgttctaaatccagggcacactgaattcaggacacacattcacctgtcttgaatccagtgcaaggggtgggctcccaaagcctcgagcagttctgtccctgttgctttgcaggatttatctcctatggctactcttatcatgggttggaattgagtgcctgtgggttttccaggtgcatggtgcaagctgccattagatctaccattttgggagtctggaggagagtggggtatccaaccccatatttcccattagtaatgccctagtagaggttctctgtgatggctccaccactgccgcaggcttttgtctgagtacccaggctttctcatacattctctgaaatctaggcggaggttgccaagcctccttcactcttacattttgtgcatgcatagtcttaacaccacatataaactgcccaggcttatgacttgcaccctctggagcagtggtctgaacagggccctttgagccacagctggagctggagcagtggggatatcgggagtaaccgcccaaggtggcacagggctttagtactcaggcctggcccatgaaaccatttttctccctaggcctctgggcttgtgatggaaggggctgcctcagaaatctttgaaatgtctttgagatctttttcccattatcttggtgatcagcacctagctctttttttagtcatgcacatctctctagcaagtggtttctccacagcctgcttgtattcctctcctgaaaatgatgtttctttctctgccacatggctaggcagcagatttattaaacttttatgctctgcttcttctttaaatgtaacttccaaattcaagtcatctcattgctcccacatttgagcttatgttgttagaagcaattggccacctcttggatgctttgctgcttagaaatttgttccaccaggtaccccaagtcattactcttaagttcaattttccaaagatacctagggcacagatagaatgcagccaagctctttgctaaggcataacatgcataacgtttgcttcagttctcagtaagttcctcatttccgtctgagacttcatcatcctggacttcactgtccatatcactatcagcactttgataacaaccacttaactagtctctaaaaaacttcaaacttttcctcatttttctatcttccactaagccctctgaatagttcaaaccatctccctgttactctgttccaaagttgcttccacattttcaggtatttttatagcaatgccctactcttccataccaattttctgtatgaagccattcttgcatgctataaagaaacacataaggctggataaattataagaagagaggtgtcattggctcaccgaagcatggcaccagcatctgcttggcttctggtgaggcctcaggaagaagcttacaatcatggcagaagacaaagtggtcctcatatattacatagtgacggtgggtgccagagagagagagagagagagagaaagtgggtggggaaggtgccgtgtacccttaaacaaccagatcttatgataactcacaattgtcacaacattaccaagccatgagggatctgcccccataatccaaatatctcccacaaagccccatgtccagcattggggaccacatctcaacatgagatttggaggggaaatccaaattttaccaggcagatttaaaaaaataaaaaaaaaattaaaaagaaacaaaatctagaaatggcccaaaatgttcattgacaccaaaatgaagaaataaattgtgatatattgacacaatgaaaaatttttcattgtcactgttgttgcattgtcattgttttgttttctttgatatgttgtttaagatgagttataagaaaatgctggtatgttgatgcaaataattgaaaagagagtactgaattgatgatgcagagaagacaaggaataaagttcttaagaaggcaagagaaaatgaaatccaaagctcgcgtgtgcatgttgttcttaggaacagacagacgggaaacaggtggacaggttgtgaatgtagcaatgggaaggtgaggtagattctctgtttgcatctatattctctacaatgtttgatgtgagacatcatcggttgattacattgtgaacagttagattgttggagaatttagagggagataaagtttaaaacaatttccacacatcttctgtttcaactttagtatgtttttttttcccatgcctgagtttcagagaggaaaaaaatgttgctttctccagattctaatgatcccttgaatttcttggtgaattggaatagctttaaaccttttactgcttcaagcactatcaatcagagatgtctcacacctgtcatttttgaacctgtagcagcaccctagtcttctttggcttattttaggagtaaacatacaggtaaaaaatgagtgcttgttcaagagtttgtattttcattcatttaaaacattgagcacctaccatgtgctataaattaactatgtgctgtaatatatgcatgagcacctctatatgcttttaatatttattcatttattcattgaaaacattgagcattcatcatgtgtattaaattctagcatggtggcaaaaaactggtaaatatgtcagatagggataatttctatgaaggtaaattaaacagagtaaggggtttgagggagtttggcattttatattggcctgctgaatggatgggctttagagaagaataggaggagaaagattggacataaaagagatccacaaatctttacagaaattttgcaaaaaagatagagtgaaatgtaaaagtagctgcaggggatgcggaggtcacaggtgactttattttattttatttcagatgggacaccatgatagttaattttatgtgtccacctgactgagccatggggtgcccagatacttgtttcaacattatactgggtgtgtctgtgagggtttttctggatgaaattaacattggaattggtggactgagaaaagcagattgccctccctggtgtgtgtgggcctcactcaatctgttgaaggcctaaatagaacaaaaaggctaagtaatagaaaatttgttttctctctgcctgactgactatctttgagctggaacatggtctttttctgccttaggacttgagccagagcatgcccatttgttctgcttctcaggccttcagtctcagactgaactatatcaccagtcatcagttctcctaggtctccagcttgctgactgaagatgggacttctcagcctccataattgtgtgagctaattcttctgtctgtctatgtctctctctctctctctctcccccccagctttggttctgtttctctggagaatcctgactaacagagatagaacagagggttgtttttttttttttttttttttttttggtgtatgtgttaattggaattctctactggagagggttaatacatgatcgggagagaaaccattgctggtacgatatttttgaataacagagagggagtggtatctagtgcatcaaaagagaagttatgtgtagaaagttcatgtaagaacaggaagtaaagaaaaacaggtaaaggtccaagtatgtgtatgtttgaaatccagtggtgaaaccttgtggaaggtctttttaaattgccataattccttcaacaaaatagaaagcaagttccacagctgagagtgagcgtgaattcaggtgttgaaagtctgataatggatgcataggtatttagtagaaaaacgaaacaattttaaagaaaacatgtaccagcaaattatacatacaccaagtaaataaattcctgtacaactctaaagtttaatttttgtgtcttcattccattatcttcactaatgtaatattgtatttaaaaacttgtaacaatagagaaaataggattttaccctttgtataggctgggtaataagcattaagcattaaaaggtaaatggagacagtgtaaagaataaaagtttttagtaattcacaaagagatcactgtctcctgaatacttccttttcagacagattgacttgataccctgaaattggactacaggacttgacatatcttcactttttttctctttttaaagaaagtcaagccatgtgatttccatttttttttctgaagtggggaaatggtttaacatttatatatgtgcaagctttatccttataatcctagagggttaaggagaccttggtttacccatcacataactttcatttgaccgtgggtggctttacttgtgtatttctaagtagtcctgctacttccagatggatagtaacctatgatctccaatcttgacctatgtacctgtctcccaaacagaaggctgtgcaagtgtacaaaaacatattcatgctaaagcacataatttctagttttgatatttaaagaactaaacttttaactctcttggtgctaaggtatggagagtacagggtgctgagtcataactaggtagaaacaagtaagagtggataaatccaggtgaagaaataaagcaactcataggaattgctagaaatagattgagtttagtttttttccttccacttttgcctttctttcagctgtctctataaaattaagatctgaaatttgagtggaaaaagctgtttgctacagtttcatttgcccattcaggtgaatcttctaatccaaaatcaactttctggcttttattaatttctggaagcaacattcttaaagccaaatatcccatcttattgttaaaatacattaacttaatttgaaaagcattttcacataagtagattttgttccaaagatgtactttatatatttttttaacttgtattttttttccaggggtgtgtgtgtgtgtgtgtgtgtgtgtgtgtgtgtgattgtagtgttatttttcatttggtggaggctgctctctgggatatgagctgttttcattgtgtgtttgttggtatgtttatacaaaaaaagagacagataagtaccacccagaaatgagtgacaatagcacttcagggtttttgttgttgttgatatttaattttattttgcatatatattatttatgaaaactttataaatcttgtcaaaaagcatttcaggagaattggaaatggtatcacaagaaaaattgcctggtgtggatcaacaggctttgtggtctgttttataaatgtgcttttttgttgtttattttataaatcatgtatgtagaaagagaaaaaaaaagaatgatttattaaatgtttatgagaaactctagtacaccctgattttaaagtgcaaggaacagacaattagctcagggatttgtcattcaggttattgatcacaataggagtctaaatggggggaaaacatgaatttctcttcaagacaacagtgttgagatgaaataatcttaattttgaattcccttttcttctcaaaagtttattatcatccagcttgcagcactgagacctttagcctttgaccaagaaagataagaattattgaggggggttatatttatcttctgttaacagtttccagaggaaggaagacatgtttttgtctccttcttgcttaagaataggagtatgtagtgttatagatcttgtttgctatgaaagaagaataactatatcaatttgattgaaggtgtcagaaatgttttgggaaacaacagaagcagagttctgaggtgggaaaggtttgacatatagccacgacagtgcttgcttggtttgtgttttgatttaatgcacccactgggtttttaagcttattatgccagaagagtgaattgcgatttgactaaagtgtgttttgtggacatttgtccttgttttacctccatgctcatataaacaaataaatgtaaacttgggatttctgtgaagggtctggaagacttttctccgtgagtgagagttttaggcattttatgtgctctcatttggatgaaaagaaggggaaggagtattttaggtgacagattgttttaataaaaggtatcccctacccatggagattctctgttgcatgtttggctgctgcagcaagtatttgcagtttaatggaaataaatagctaaaaatcagggctcacactcaagaaagtcaatgacacccataattatccttatattcttaacttttttcatttgtttacatttttgcattttgatgaggaacttcacttccaagtgccttagttttcatatccacatagtggggtccataatgtgcttttacaaccctaccaagaggatcaatgaggttcgtgtacatgaaggggcttaataaatagtatgtgatttgagctttctggatgaaaagtactacgtgagtacaaagtagagcagcctcccataggtaatgcctttgcctggataactctgattataggctttatctctgcaaagcagagatttttcttcttgattccttcctgagctaaggtgcctatttcctcagtaccttttccttttgagctcgcatacaccaatcaagaaacacacttgcaaaaagatttgtttacttaagtgcacacatggtcaatcacataaatggaaatatgaaaaaaacccaaaacagtgtgaaaggaacgttcataacacatcaagcccccagatggctctcagaaactctgacatctcaggtggacccacattttagaatatgtattttcaaataaaaagaatgtatcccaggtaccttaaataaaatacagaatatgagctgttttcattgtgtgtgtttgttggtacgtttatataaaaaaagagacaggtaagtaccacccagaaatgagtgacaatagcacttcagggtttttgttatttaaatttgactgccttatatacctctttgttgtatagctttagatgaaagtgataacaagaaataattttataccacactttaaactgtttacaaaacattttcacaaagattatttaatttgtttctcacaacaatcttatgaagcaggaaaaacctcggaaaggttgtgtaacttgtcaaaaaatatcctactgttaagtggcagtatgtagtttagagcaaacatcctcagtggttttccacatttccagagatggcaagcgagtttactcacacattccatatctgatcagtgagtggcagctgcctacagtgctgtgctcaggatgtttaatctatatccagtatctgagggaaaaggtgcaggaattgattagtgatagccactctgtatttgggcagagatggggtcatgagtaatacatatcttccaattcccaaatgtacaccataatgtgtgtttttaaagtgttttgaataatgtgtttgcctctgtagtattcaagtaaaataggtatctctgaacaatttgtaccaggagtgagtagtggatctgctaattagctatgatatgcaaaacatagtcacttgttctggaagaatttcgtggaactactcctttatcttgatttctgatttggaaagttggcagatgattatcatatgactatacatgtctttgatccttttgtcagtctcttgtatttatttatttacttatcacaaaaactcttccacctttaaaaacttatgctggatttttcatttaaaactcctttaaaaactttaaaaactttcatgtaaaactcctttaaaaactcatgctggttttcatgctgggtgtctgggttaggtgaactccatttaaaatagttgatgtgagtataaaatcaaaatatagaggcagtgagtaacaaacttctttctaaaaacttattggtaaaatgaaggagaaagaaagagagataacatgcaatagaagtaatgtggcagagaatcttctgagtttccagatattctatcagggaggtgacagtctgttcttaatattggtagacagcattgattgctggataaattattttggaagagcattaatattatgataaataatttaattctgtcaaccacaggaagtatcctatcttaagagacatatcagaagataggtcttttttgcttttaggaaaataatatgactcatacagttaaaatgatttctgatcctgactatatctgggtgcatgaccatactgatattttcccatcagtttgcagacaattggcccactttggtgatgagtcattcagttccatttccaatcttggcattgaaaaatacatagatatttctagtataaaagaagatatttccatactcttgcctgaaaattaggtttagagctatatgatctgttattttgttactttcatcagaaggttttttgcaatgatattttaataaaaattgctctattacatttttacagttgggaagaacctttaaagcatgaagtagaatccatcactgtatggttggcttccaaatttgtatctcctgcccagacacttcctttaagtcccaagcatatatcttaatacagaaggaaatttggagtagagaaagccagaaagatggatatcatctctgacactttcttctccttgacaccctataaccaaccatcacccacattttatgatgttccttccttaatgtttctaaaatctcaccatatcacttgggctgcagagttaatttccttaggtttactaagtttagaccaagctactgatctctcctggacttttagttttgttctgattttccaacaagtatcgttgcccctttcctattcattctacagaataagctttgcaaatgaagctggtgtggattctttgccacaacacttgagtataagaacacctttatttctatgaacaaattgactctgccacaagacccagcaactttgggtatgggaaattcagtctcagtggagttaggttaggaaagccagagtcagactgtcagagctcaaatactgactttacaagctatgggttatcaagcaaattacttatttcttaaaatagtcttaatttactggtacttgtaagtatcaattaagatcattccaataaagcttttactgcagtgctgggcatgatgtagtgaagaccattctcagggctgcatgggcagccctcactgtctgctcccaaccctatagcattcatgcttggtcacacctacaggaactctgacattggttctccagctcaaggttcatatagtccaccttccataggcatcctactctgaacgattgagacctgggattctactacgcagtgcaccccttcccacccctgagctctacctctaacctcatcccttctcttagtctcgggtatgcctgccttcgtggattggatcagactgcatctgcctcttcatggcaagaatttccctcctcctctccttttctggaataagccagtctaataccacataaatgacctgcttgggtgaatgttggagggtaggggatcagaagaggggtggaatagtggggaattgggaaggggaaaggaggtggagataaaatgactacttacccctttggatgaacaatcttggccgtcctttccttgtatcaggatgggaagaaataagctatgttttattttttctttaaaaacagctcattttaacacaaactcaactctcacgtcacctacttttattaggcatcttttacagctcagttccatctaggcacagaatctctgcgtctaccatctccatgttcttttttcttcctttgcctcattgacttccgctagtccttcatatctcaagtcaaactgactcagataatccttctctgatgcaccaggtgatgaaaaatccacctgttatatattttatatttctgtgtgtttctccacccacccattgtagtttgaagtgatcttttaaatgtatatgtaatatctgtctcccaccagactgaaagctctaggagggtaggaaccatatctgtaaggacagaaattcttgacatcaacagcatgcttggcataaagtaacttaatacatattttttggctaactgaataggtaatttttcatgagcactaagaattcatattgtctgtagtaccctactgccctttagaacttatttttacttttaaggattttatatctgcaaaggacagcaaatatgcagtaatctattcttaattatgttatagctacagaacaatttcatatttgcattttccagttgccttcattgatcaaaattagaaattaattattactactttctgttttctgcattgtttattacaaattactggtatttataattaatcttttgataaagcattataagtttacatattgattcatatgcacacacacacaaagatgaaaacttccttttttaggatgatattaactatggattatctcaatctttcttctcttctttttcttctctctctaccgtttctctctccctgtctctccctttccatgttcctccccactccttggcacacaaacatataccccttgatctgaacctgtaaccataagaaatgatgggagaagccatccataggtgaactgttgagcttcaagttaagatacgtgtgatattaaaatgttctctttgaacttacagctctccattgtaattttaaaatttgctttatcattttaaaggactaattttatttggcagtccttccaagatcctgctcttaaaatcactttggaaattaacaaatgcatttggttttcaaatctgctcagctgggcaccttcagctccaaattgctctgaatttgcttccctcatcctcttcttgccaccctacttaactcagagaaaaaatgaatttccagcagagtagaaagagaccagttcagagatctctgctcttctctttgagggtgaatttcattagacaaatttggcaggaatattatcagtcaattaataattaataaaatgtgaactgaagtcaaattaatcttcagagtactggaaaatcagttgcacttctgctaataaggactcagtgtgcatggaaatcttactggagactgagtacatctctacattgtatagttaacctgattttttccagcccagtttacttattggcattagtataatccacacagggaagtcacaataaccatgataaagtgatgttagagataattaccatcctctttagtttctcaaatattcagaaggttcttcagccctcttgtaggctgctgaactttaatgttaggatgaagatgtgcaggtgctttttttgtaaattttgattttattgtcttaagtacagaaataacagagacattagagaatggcagaaaacaaggaaaaaacttatattataacatcgctctaacacatccggtatcattttgatgtggacccttcttaggtttttcttcctgtgtatttttacacagtggtaatcacaatattacatatttatttccccttgatatttcagaaattcttccacattacaactgagaatttttaaagtaccaaattagattatctaacaaatagatgtggcataatttgcctaaacatgtcctgttgttggatatcttggctgcttgcaaccccttcaatattctaaataacattgtaataactaattttgtgcaagtattttgctttattttcctaaaagagattgacaaagtggtattatcactgcttggcttttgaatggttgagattaataacattcctcttctacatgaagtgtcatggcatcccagaaggagagaattgtgagtttctgtgataattctatagaagcttcattcatttggatagtttcaaatgccctttaagcaatcttttgtatttcacctttcttggaacctgctgaattatcttcatctgtagaaagagaaacaacagcagcagcaactacacactgagtacttatgccaatacactaagcccttcatttacattatgttaggtgttcttacaaaaaattacctgaataggtattattattacacctactttacaggtgaagaaaggaaaattcaagatggctaggtaactttctaatgtcataccaggtaaatgctcctgaactgggatcaaaccctagtctggtaatacacttcactgatcacgcatgtaatggacatactttttcacaatattgataacaagtatgaaagcttcatgctctttacatttcaagtgctaatcccactgtttgttgaagttagtaagtgctatttcatcaggtgagtaagaactctggagatacagtaatcttaacaaggaatattggatgtaattaagtaatagattatatttttctcggtatctgcgtggctacattgaaaaatgtgtcataaaaagaccatgtcttttgcattcattgctacattactaatttcaagcacagtattaacacagactggatatttattgtgtgttgaatgagtaaatactcaactctaaatgctaactaattctttccaagcaatttattcactcctagcatctgatctgtttactgtgccttgaccaagtaaatttctcagagtcctttttttatccaataactccattacagtacttgtaagtttctcagagtccttgtttatctgttaaatctctttcgtcatattaaattaaaataccttattgcagattgcaaaatatgtcacttagaaaaacaaaacaaagctaatagtaaaacaaaaaagttaccagtcctagagcctatacatgtacttgcaaatatgaaaaaaagcttaaaaatttaaaatcctgtagaatcaaaatgaaaatgtaaattaatatataaagtataacagcgctgtatagtcaaatgcaattccactcaactcttaaaatattatagatacattttattgtggtaagtaggtgtatttttttgttgttgttgttgtttcaaatgatgtggggtgatgccttcaatattaagagttcccaggactgccaaagtcatacactacatatcactgccgcttggtttgaataaaaactcattagtcctacactcattcctctggctgttgaaggcctgattctagtaagtctgtcttgctgctgctggttgaagattagtggttggtgagcctaaaggaaaaatacgggcctacacttccagttaaatcctacttataaactagtacagacttttcctttttttctcttatttgagcaaatatgtacctgcatctaagtttcctgaaactattttctgcttagagactatcctttagacattgtattagacacctcatgtgcaccatttctcataatctcactcttacctcttacttcagttattgtagcaaccaatatcaggcagacttctccagcttcacacagttcaccaagaagcacctctcttgctttctgtttggggcttctttgatgctatataggacacctgctggaaatttcctggtactgaaacatgtacaaaccacatgttggggggtctgggccaatcaggaagaggagcttgtagacaaatgcttctcgtttcttaccctgcacagatggtttgaacacatatttcataaagctcctcaaaaggccctttaggaccaaacgacccaactcagtaattcatctttgtattggctttcctcccttccatttatctgccactcatttctgctctttcaaatcacattcccaaaataacttctcacatattagcatttgtttcagactttgcttttagcaaaactcaggataagacagtcatgtctgtactatgtgtaactattaagacttttccaagaaacatttgatgagttaagtttaaggtgactggaaaagtcatttgggtcatgcatctttgttgatattccacttccccacaactgttcagcttgttaaaacaatttgcctactgtctgagaaaattacagaataatcccttatttctcaaccaaacttaactctcaaactatagaaatgttaaatctacctcctgaattaatatattattaatcttgatcgaaaaagaaatatgttcgctatttaataataccactgatattttgatgcttttgcttccaagtagtatttggtactgctttttctggtttgatgaagtttcagattgataggaattttacatgtgaagacagactagctacagttcattgtgtcattctctcaaatacaatattcttctggttccttgatgacacattttttcaatctggatatttagaaactccttattctgatatcatgttgatgcccatccttagcttttggaaaagtttgctgtattggtggaaatgttagcctatctgggtccagagttcatagacagccttgagtcagctctgcttgtgggcttgttcctggttctccagctgtctgtctgattgatttgatctctgcttattgtctgccatcagagtcaccagataataaactctattcaactgcagggctatctccctgtcacctacttctggacatctggaatacttgacacctgtctgcctcagcttccccccattcccacactattcttcctttagtttgttactagcctttcctaacagcctctcctctgtcctgtctgccctggtgggggcatcctaccatctgtgtcaggtcttcttgagactggtcatttgtgttgttgacaaaatcctggttctgaaacaaagagtactactatatagttgaaatatgtgagaagcagaaggctatgggtaaataataattaagcaatattttacataaagactaccccacccaattttttcatttatattctgtacagaaatctttggtttcaggaaaatgtagtcagaatgaaaataaattatgtatcttgtttgggaataggtatggtgcttcattaccaaaatacctaacttacaaatgggagataattttacagatttaaaaatgggaacatatttctttcaaaaacattttctattttggcttgaactttaagaaatcgccttcaatgattggttttcctttctatggctactcttgatctcagcattggtttctctctctcctaatagaagatgcttcctcccatgctccatatccaactagctagttactgatgttggctgtggcatttttttttcttttatttttctgaaattggagactctggttgtgactcaggcctgtcgtcctataaatatgtactgtggatctcagtgggaaccagagactagagagtaggactgcattgacatagaatccttgtgtgactagcacttctgatagaacatcattaacaccatctctgtatgaagaaaaggtcttaattcctttttaaaaaattttattttgaaattgacagattaaaattgtatgtatttatgatgtacaacatgatgttttgatatacatatgctttaattattcttaattaaaccacccccctgggtggttcttcttcatttgttgtactttctcatccactgatggcagatttatcaattggatgatatgtttgtgggagaggaatattttttgttcttattcttatttggtgttttgctttatctgataagaagtaacaattttccacttgaagatatacacacatcttcctcattcctagtgcgtatatggaggaagaaagctcagctgtgacaatgcagaacatatggtaagttgcttgtagaaccctttctgctacatagcaatctttggtacgctgttgagaaaaagcctaatttgcgactccaagcagctatacttttgcttcgttttgtatttttgagcattgcgatggaaatgaggccaaataaggtgaagcagaaaaattatgccttttaatcaaaattttctaaaactatggttgcccttactttctggtgtctgagtggttagggggttttctattatccaaacattaattactcaacctgaaattatttagacttaaaggagaagttatactcgtctgtaattatggctgtttgatcaatgattctgacatttttacatgttcactattgtgaacaagaaaatcaatttttaagatttgctgtttaataaattacaaaattaaaaattaatctgattgaatattgcatatctataataaagaaaattttagatgccattttatccagtaagggacagttgttcctttcccaagtcttgccacacacagtgagtaccagatttaatattttgataacactttgataatgtcttgggataaaaagttaaaaatgttgtcaagtatttccacataacctcattcagctaatggggttgaaaaaccagtccatctctaataaatggatattgccaattaaaaagatttccccaaagggctctaggtttcatgaaactttcattggcaagttatatattaagcagtgaatcctaattttcaaatatagtatttgaattataatgtttacatatggaatattttataatttataaagagtctatttagtaaatagtgtttaggctgagatttagaacaaactaccctctaattctttttttccataggttattgggggtacaggtggtatttggttgcatgagtaagttctttagtggtgatttgtgagactttggtgcacccatcatcaaagcagtatacactgcaccatatttgtagtcttttttgtctctcgccccctcctacccatccccccaagtccccaaagtctattgtatcattcttacacctttgagtcctcacagcttagttcccacatatcagtgagaacataagatgtttgtttttccattcatgagttacttcacttagcataatagtcttcaatctcatccaggcccctgtgaatgtcattaattcattcctttttatggctgagtagtattccatcatatatatatgtgtgtgtgtctatacatacatatatatatctctctatatatctatctatgtatatctctctatatatatatatctagatatatatatgtgtgtgctttaaaaacagaagtagtgacaacatttagaatagatagggtcaaaatgataattgcaataatgattgtgtgtatatatatataccacagtttcttttttttattattattatacacaatgtgcaggttagttacatatgtatacatgtgccatgctggtgtgctgcacccattaactcgtcatttagcattaggtatatctcccaatgctatccctcccccctccccccaccccacaacagtccccagagtgtgatgttccccttcctgtgtccatgtgttctcattgttcaattcccacctatgagtgagaatatgcggtgtttgggtttttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttacagcagcatgatttaaagtcctttgggtatatacccagtaatgggatggctgggtcaaatggtatttctagttctagatccctgaggaatcaccacactgacttccacaatggttcaactagtttacagtcccaccaacagtgtaaaagtgttcctatttctccacatcctttccagcacctgttgtttcctgactttttaatgattgccattctaactggtgtgagatggtatctcattgtggttttgatttgcatttctatgatggccagtaaagggtattcaattaggaaaagaggaagtcaaattgtccctgtttgtagatgacatgattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaacgcccattcacaattgcttcaaagagaataaaataactaggaatccaacttacaagggatgtgaaggacctcttcaaggagaactgcaaaccactgctcattgaaataaaagaggatacaaagaaatggaagaacattccatgctcatgggtaggaagaatcaatatcgtgaaaacggccacactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgttacctgacttcaaactatactacaaggctacagtaaccaaaacagcatggtactggtgccaaaacagagatatacatcaatggaacagaacagagccctcagaaataacgccacatatctacaactatctgatctttgacaaacctgagaaaaacaagctatggggaaaggactccccatttaataaatggtactaggaaaactggctagccatatgtagaaagctgaaactggatcccttccttacaccttatacaaaaatcaattcaagatggattaaagacttaaacgttagacttaaaaccataaaaaccctagaagaaaacctaggcattaccattcaggacgtaggcatgggccaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcacctactcatctgacaaagggctgatatccagaatctacaatgaactcaaacaaatttacaagagaaaaacaaacaaccccatcaaaaagtgggtgaaggacatgaacagacacttctcaaaagaagacatttatgcagccaaaaaacacagtttctttgtagactcgttgattgatggacatttgggttggttccacatttttgcaattgcgaattgtgctgctataagcatgtgtgagccagtattttccttttcctctgggtagaaaccaagtagtgggattgctggatcaaatggtagttctacttttagttctttaaggaatctccacactgttttccatagtggttgtactagtttacattcccaccagctgtgtagaagtgttcccttttcactgcatccgtgccaacatctactatttttttcttatggccattcttgcaggagtaaggtagtattgcattgtggtttttatttgcatttccctgatcattagtgatgagcattttttcataagtttctggacatttgtatatcttcctttgagaattgtctattcatgtcctcagcccagttttttacgggatttttttttcttgctgatttgtttgagtttattgtagatgctggatattagtcctttgtcagatgcagagattatgaagattttctcccactctgtgggttgtctgtttactttgctggggtgtttccttgatgtggtactcttccccttttcctatggatgtggcttcctgagaactgagctgtcgctattgctatctctcttttgggtctagccacccagcaagtaggcttgctggtactgagggttttctgcacagagtcctgtgatgtgaaccatttatgggtctctcagccgtggatgccagcacagtatttggggtgtctctcgggtcctgcaggagcaatctacttccttcagagggtctgtgggtcctctcaggtttcctgatttattcctgcagtcagtaattctggagctaaaattcgtgatgtgagtctccacatgctgctctgttcatctgagtcagagctgcaatctagtctttcctcctgtctgccatgatagaatcaaaagatcaaactatcctctaattcaacactaattttggactcagtggaggactcctataatcccattttcctatccgttattttgattctagttctttattccaaagacattacagttgtttccccacattgaaaggtaaaacatggaatgttagaataaagatagactttggaattataagaaaataaggttcaattttgcctttgattcttaccagagatgtaatattggttaatttaccaattcttgttcagtaaaatttttctctcatcattattgctatcatttagtgaggaaaaaatacacggtaggtcttttctagaaaattataaacatctcaattaattttcataacaccactatgaggcagatattgtcatctgtatattttatctaaggaaactgagtctcaggaaactatataattcttttattttcatgcagtaaatgccagagtcaatattcaaactcagccttctatattcctttctgtcaatatcagattcctcttatcttggaagcatgttgtgagaatttagtaagataatctagtatattttcaggcatttagcaaatacctgcaaatattggtatcctgtttaaccttcttcattctacttctagtcatttgctaatttctgctttttatgtctcttttagcattgttttctcttatatttctcattgttttccttattctggatattgctttttccttgaattattttttgtggccctacttcctagctttccctcattttccctctactaagttatcctccatattctaatatatagctctggccatatgactacttccaaatcctccttctcttaaggcttttcagaaacctagactaactccccattacttacaaagaaggttttaatgtcttagcatcacttttagagccctcccaaaagtgaccatgcacgactgttccaagcttagttatattcataagagcaaactaactactctcactctccttgagcaaagagtagaggtgtatgcatatgtctgagtgtgcttctctaatatttctcacactattattttcatctgatgtgtcttccctttcactccccagtcctgatgttgcctgccatttctacccataagttttaaaaaaccagttgaaaactagttatttcatgaagcctctcctgttcttagccataatctttcttctaacttccattcatagaactttgaaattctattatattacttacaatgtttttcttatactaaaattggttatgtctacatattcctctagtgttaagtttatctcccttgaagatagacatcatgtcttgttcatctttttaatttttttgcaggactatgaacaataccatacatctagcataatcttaataaatggaatttaagtaaatggatgctcaaagaagagacattctggaaaagggaaaagagcaaaagctttggaaatagtcagaaatggtttcaataatacatctgccaggtgccctggctcttgactataatcctagcactttggaaggctgaggtgggcagattgcttgaacccaggagtttgagaccaggctgggcaacatggcaaaacgctgtctctacaaaaaaatacaaaaattatctgagtatggtggcacacgcatgtagtccagctacttgagagactgaggtgggaggatcacctgagcctgggcaggtcaaggctgcagtgagccgtgatcataccactgtactccagcctgggcaatggagtgagaccttgtctctcattctctctctctctctctctctctttctctttctctctcaataataataatatatctgccacttaacagcttagttaggcctttgcttttatatctgtaaatggggacagtagtgtctatctcagatgataagtggtaagattgaggtcgtatatacaacagcatataaaagtagtgaacactatagcatgtgatgtatggtaggccctgttctaagcactttgcctgttgattcatttaatccttgttatagccttatgaagtaaatactattataagcttatctttagaatgaacaaactgaggttgagagatattaagtatcttgcccaaagtaactgctgtagtttgagtgtgtcccttccaaaattcaggtgttgtaactgtgatagtgttaagcagttgggcctttataagatgattaggccaagaaagctggtttccttgttaatgggattatgcccttttctaaaaagtcttcctgcaaaattcagccagcttgctgttctgctttctgccatcggaggacacagcaaaaaggccctcagcagaccaaatgccagcaccttgatcttggatttcccagcctttagaattgtgacaaatatatttctgttattcataaattacacactgtcacatattttggtgtaggagcacaaaatggactgatagtaagtgaaagaactaagatttgaattcaagaagtcaggctatagaaagcatgtgtttcagcattccatcttggtagtctactttccttctttataagttaagaatagtttttatctaaaaataaattgaaaggggctcatttatcaagtgcttgtaatgaatgtcagtgacccaggtagaatatggtctctgcccctaacaaggtctcagaatcatgggggaagtgggcaggtaaacagtgtgacaaatcctgtggcagcagtatgcacaacgtgctatgagaaaacaaacatatctcctagtcagcaaggtttttcttttcagggtgtttttacttttatagaagactttcttctctctgtttctgaggccacaaaaatgaagtgacttagagcagtcttcacatgaggtttaggactccaggtgctaaatagtctacgatttccaaagcttcatatttttatccttgtctgtgttatttagctcttcgactttttcaaatcagatgggctacttaatgaattgtcatctgtagatcaaatgaaactggaggggagacagttttgatatttttctattcaggctccagtaaggaaagtgctgtatatctgaaacaagatagtgggtgaacacatctggctttttgagcttgtgttataaatagaatatcaaacgagttaagagaaatagccatgtagctatgaggctctgtgcaacaggatttaatgtcaaaaatggttcatattatgattatttttttcaccactctatcctcatcaagtgtctgaaagataccaggaagcaaatacacagaaataggtatatatttcaatagtaattatccaggctaattaaaagtaaaatcttgtatatagaaagagaatattatctggcaaccagccaaccacagagtaccagttttgtcagcgtagctcattttctttcagaatgtgatatgtctagaaataaaccttgaagaaaaatgtgagatggggaagagaatgaagaaaaaaggtcttgtttagtataggaacctgtccatctcttgatgcttgccatatgtgctttgtttttatatcaccagtttgcatatttatcatggtttctacatattgatttgcagttttcacactcagcctcttacatttctctcagtatataggtagacaccctgtcacagtgaggggagttctacttgctgtttaatgggtttctcatagtcagtgatagattgagcatttgtgatattccaggagtagaggtctcaacaagtcagaattactccaaaagctaccccaggaggagtggaaaccctttacaagagtgtaatatctctatttaagtatgtcttcttgccaggagtggtgtctcacatccataattcaagcactttgagaggcagaggcaggaagatcacttgagaccaagaattcaagaccagcctgggtaacatagaaagacttcatcttaacaaaaaataaaaaattagtcaggcatgtggtgtacacctgtagtcgtagatactagggaggctgaggtgggaggatcacttgaggccaggagtttgaggctgtggtgacctatgattgcaccactgcactttagcctgcgtgacagagcaaggctctgtctcaaaaaaaagaaaagtgtatcttctttatatttaagacatcagaaaaataccacatcaaaaaaaatcatgtgctttacgatttttgctcctcattttcctaaatccaagttgaagtgtgaggtatgacttgatgaggtaagacacattgagcgtcgtgtggttcaatagagcagtggtgtctacgctaagatgaatatcagaattacgttaggtgcttctgaaaaaaaatactagggcctcaccccaaatatattaattctgttggtcatgggtacaatatacagtttgaaagctcttctagtgattttaatgatcaagcacatttaaaaccattgcagttatgagcttagtatctttaaagtgtcacacgattctactatgcagctaggaatgagagcttctgttttaggagttggaaagttaaatgtagggataaagtgtggtataacatgagtattggactaaactaaatagaggtatctaaagaccagagagagaaggtagtagatttggagtcagcaatgtataaagctccttcctctttaaatctctaaggctttaagtagcattaagatcaataatcctacaaaacatttcatttatcactgatgtccatcaagctatatatctatatcggcatggtcgtcagagatggggaatatgccagacattttggagatgaaagagaatgcaaagggatttccatatttgtccaaaaccagggagggtggaggtgttgggggataatggatgaaactcacttttactgagtagctgctatgttccaagtattttgctacttaataagtgctactgatgaaaatcatagtagtaactaacacttttatggtgcttatgtgccagacactgttcttaagtactttatctgtactaattgaatacttacaaaaactttacaaagtagaaaccattacatttccctatttaaagatgaagcaactgaagcacaaataggtatgtaacttgctctaacatcacagagctagatggtagcagagtttagattcaagtaatggcagaccagatcctgattctctgcttttaaccactttcaataagtggacttagttgatgagtctagaattcgtgtataggtggataaaagaaagattgaaccgctttctgaggaatacacagaattctggctgatgggagggctggacactgatggtgatcacatgactcattagtgtgcctctgaactaagctcttttcttaaaacaaaccgtagacataggcaaagaaagcagtcattatggatagattgtaagagcattatttaattgtgaggccattctcttaaatttatcagtgacatgatttattttcctatatccttcattcttagcacacacacaaatctcctttctagacatttgactcttgtttagtttaatttttcctttccatgtgctatttttctacctatcacctcaggcacaaatacaaaaggtcaaaccaaaaaataaacaccctgtgtgatatccagtaaagtcaaaacaatgtaacagaagatatccatctttattcttttatggcacataatacattcattttcactatctccaatttggtcatctatctatgtcattgtgggcttgctgtaatcatcaaagagtaagaggtagacatgttttacatgcatcagctggctagataccctatatcttttatggtatgaacacacaagtaagaaattcaagccaacaaacaaaaatcctgccatcttcatcagcaactaaccaatgtgcacacttgggtggagatcccacctttcacctatgacctgggaatttttagatggctccagtttcttttagtcacccttatcctgatttcctgttttcttccgaatttttaaaatctctcctgtgtacctcatttcctaacctttcgttttatgtgcattgaacctattcttgcattttccccaaagcaatattagcaaaggtatttctgtacctcatgattttaccgagggcttaggagcatcagaagtaggttatgttgcctcctagtactgcaaatggacaatgtttacattttagatgtccctgtttttaaagcccctaggcgtgaccgctaaggtatttcacaataaccatcttttactcagggtcttcatcctcctgctttcttgacaggcagcttctcttcttcttacggtgtgtcacagctacccaaattctcatttttcctgtcattttttcatgtcttatttgtgagttcttggaaaagtaggctgtggggatttgccacatgacaacctttccttcatctgcaaagaggtggacttgaagtactatcagtactcttagaacagagatctcatggcctggactattccatttccaaaagatcttgtacataagttccaacagatgagaaaatgataacatgaggtgtcctggaaaatgttcacatcttcctctaggatatgggaaatatgcaggcttgctattttgaattatttcttttagagaatagaggaggcaagtctctcagtggcccacatgagaaataagaagttataattggaagttactctgcacaattatcctggttataaaagaaagtactgagtcacctccctactggggaaggttatgtttgcggagttttgactataaagtaacctccctttgcctagtcaactcaatccagagggcaagggtcttcgctgttctgagttttgtaagcaaaaaaagaaatcttaccagcagattgctgggacagctttacaggtaatatctgattattctttaatccagaatctacaaggaacttaaacaaattcacaagaaagaaaacaaccccatcaaaaagtgggtgaaggatatgaacagacacttctcagaagaagacatttatgcggtcaacaaacatatgaaaaaaagctcatccatggtcattacagaaatgcaaatgaaaaccacaatgagatatcatctcatgccaatcagaatggcaatcattaaaaagtcaggaaacaacagatgctggaaaggatgtggagaaataggaacgcttttacactgttggtagaagtgtaaattagttcaaccattatggaagacagtgtggtgattcctcaaggatctagaatcagaaataccatttgacccagcaatcccattactgggtatacactcaaaggattataaatcattctaccataaagacacatgcacacgtatgtttattgcagcactattcacaatagcaaagacttggaaccaacccaaatgcccatcaatgatagactggataaagaaaatgtggcacatatacacaatgggatactatgcagccataaaaaaggatgagttcatatcctttgcagggacgtggatgaagctggaaatcatcattctcagcaaactaacacgggaacagaaaaccaaacactgcatgttctcactcgtaagtgggagttgaacaatgagaacacatggacacagggagggcaacatcacacaccagggcctgttgggagctgaggagctaggggagggatagcattaggagaaatacctaatgtggatgacaagttgatgggtgcagcaaaccaccacggcacgtgtatacctatgtaacaaacctgcatgttctgcacatgtatctcagagcttaaagtataataataattttttaaaaaagaaacgagactgttgaaaaacctttctgactggtatctatgtgttggagttgtaaatcttttactcaatgcctcaagaaaagaatcaactaattatctatggctttggcaagaaatcttcgctgatatttgtctaaagctttctaaaacttgccccaagccccaaagtccaagtccaactttcatttgcaaagtaattcagagctcccttatttcttccttacttcccagtcctttctctgtgctattcttttcacttcataatcattcatcaagaggtttagtgaaacaaaaaacacctctcaccatttgattcattctatgtctactttctataatataaataactattttacccctccatgttacagagtcatgatgcactgcactgcacctttacatttgaaattgcagtctccctcctgagcctactttttgttacattcgttataacatatcttccttttcctcctcattattcttttggtagccatttttttaaagcactttcctaccctatttaaatattttcatctgaaagatcagaagtcttcagagtattttgagacgcattggctgaacctattcccccacttccccacctcccaaaaaatgtgagtagagacaatgtagcttgaacatttatttgggcttccaaaattgaattgaggaaaacacccaaggtgcctgctgcctgctcaatttcttgaccaacctacactattttgtgaaatacactaaatgaattgatttcataccaccgttgggaaagaataaacaatgatagggtttaaataatgaaacattaatatggaaaaaattattgaggtgtatgaagcttatcgctttgaaaaatattttaatcatagtagacaaaaacatgctcttgatataaccactcttgtgaacatttctcttagaatttggttaaaaagaaatattccttcagatgaaaggaggggcttccctgttttctttattttaccattaaaatgacaaatgggatgttatgaagcatctgatatcactttttatcatgtttgatgtcctaacaattattgttcgtttatagttatcagaatcataactgcaatacatttttgtgtaaactgccttgatgattacacacagtactggctaaagagacttaatcaaaattacccaacatccggctgaactgttgactttggcctggtaaatttttttttttttttttttttttgccatttagggttaaacatttcttttttgacttacttttcggtgaccagatagttaattctaagtgaaacagacaaataaagcagaagtgtgttaggtagaaaattgtgaaattttcataagaaaatttgtgaattccataagagcaatacaccagtcttaatattaaatccaatctgtcctaaggaaatgccagatatgtttttgaatcaccaaaatgaaataatgatagttaaaaaggtaagttgaaaataaagaatttttaagagaccccaaaacccgaaggaaggaaagcaactgtggttaggagaaataatagctctacctattaattagggataaataacttcagcaagtactcctttaaagttttttctgtaaagtaggggactagagcatgcaactattctaaagtatctttcagtgaattagtttccatctttaagtagttatataatagtataaataaaataatgaatacagtattaatattaatgatgagaattaatagtggaactcatttggtaaatctattctaattgataccagtacaaggctcagacttaacagaaataaatgattaaagggttaacaaaaatctcttcaaaggaatctcttttttgttgcaaataaaagcaggtttaaaattctctctgtgttcaaaagtcaattattgccaattttacaggctcctcaaacatgagattttcatttagcagagccaactttactctgtctgccaaaagcccataaaatggcccttttccatctggtaaatgttccacaatgaaattagaactgttggaaaataatggaaatctatggacatgtgtatactgttactgagacgtgaaaatttgttagtgatatctgatataaattacttatttaagtgccattgttaactcttgtaggtcagtaaagcctgagttctatattagagttcatgcaatttcctaacttcaggtagaagttattcaaaccattccagaaaataggatgccccatgtaatcaaatagtgattcttaaatatgtgtgatgagtgtcattaatcccttggaagaacaaatgagaagtattgattttcaacccagaaaaaaagatgctatataaaaaaatagaagcaacttcagcagttagatttaaaaaaacactattccaaaaaggtttttgaaagagggattttatagagtcccttaaaaatatatttaacatttctcaaaaggaaactcttttttaagctcaacatgtaaatttaaataatttcccatagattcatttactcaactctatattactggcatttccccctttgaagatataaacaaatttctcatataattttttactacctggtgaatgggccacaaaggagatagctcaactagtaaaaatggtttgccttttcccatgtaccgagaaaaaaaaatcaaaattatatatatatatattatatgtgtatatatgtgtgtctgtgtgtgtgtgtgtgtgtgtatatatatataatttgtatgcgcccataattcagggaaatgagttggcatgtgcataatgtagatatgattataagcttgagagaagaaaagatagttttaatatatgaattttaaatttataaaatgtaaatatgtatgtgtatgttagctcttgcctcctagctccttgtcaggaagagaaaaccccaaaactcttatcctctgaatcataaaaaaaaacttattttatcagatgttcttaattgaagtaaaatgatccccaagggtagaaagaactcatgaaagttcacagaggaggaaaaattctgagctagataagaaaaggacaaggagctggccactgataaaattaaaatgtatggaaacaattagttactattccctaaaacagcaaattggctttctgaagatgctttggggaatttcaatttgtttgaacctgtaaatgctcaatttgatcgtaagctcagtgaatatttcctaaaagtttctgtagtgccttgttttctaactgtattgaagaaactatcaatctgaaggttttctctcctctttgagggactggtttcacatgatgatgacaagaagtcttttcaaactttatgctcagagaaaccacaagatgggctgtactggcagctgctctggagagcagactttgcagtagactgtgaacatcatttctcctctttcacagcatggggaattccagctctttctgaaatctgttcaaaatattcctgtctttctattttacctccaaaccgactcattttcagacctgcccttggttacctttgattgacagatataggctttggaaaccattgaaatcttatttagaaaggactgaaatcttatctcaatgaattctttagtccctgtttggagaccaaaggctctatgtcaaaaggattatagatacctgtacttgcaactggggtttctacggcagatttataactattgggttatttcagggtttccaagttaagatctgatggagagaggaacatagagaggcagctctaagatggacaatgcacccataaatttttttctgaaaataagaatctcttttagatatgtcatagttaataaaaaaatagagtaatacaaatgaagacttaaattgatgaggcacatgtgtaaattgataaaggaagtttgatgcatcataacattgaaatttatctaaattcaatattgttaaacattcttaaagatcagatgaattatacatgaagtatatggattatttgtccctggcaaacaatggtgacatttctgtctgtcacttagcatgacaaggttagcatgttttattcaaaacttttaaacagtaaaatgatttgtatgcattactcttgctttggactgtcagggaaagcagaaagcaacacagttattctatgacattgagtcagtatgtgcataaaaaaatgacagaacaggattgcctcagacatctataaagctcatactttggttttctaatcatcttgtagaaaaacaacaaaaccataaaggcagaagcatttcctcacattcaaaaaaataccattgcatacaggaatataaatatgatatttgtaatataatgaatgtgggatatttacgagtcggaatggatccctggaaatagcatgctttgggttttaagaaaatttaatgacagaatatttttttttttcagtaaataggataagagtcaggctatgttgtctctttcacagttaaaatattctgcagtaaggaaataggatgataatttgtgagacctttgaattttttgctctctgtgtgcgtaggatgggcacatagaaagagataaataacagagtagagggcattgttcagctcttaggtagagacaggggacagaggactttagtaatatgtttactatttctgttacagttgtctatcattggagggtgtcaatgttaaggcctgatagtgtggttgagtggcaatccctgaagcagccctcagcttgctccttctcttttccctgacttttctgtgtcaagtaagttagacaccaaaggaaccctacacttcactgtttctgggctcttcttcctccttcatgaggttctagagcagaaatgagctttgaggggattatgctgggataaaatagaacctaggggtcttggtacgatattaatatctaatatccagagactaaaagtcttttttattgtcttttcattcacaagtgacttagggatgctttttgagaatatattatgaaccagtgactctgccaggaataaaatgatgtctaagacaagcttttgactttgcaatgcttacaacagaggaagaaagctctataagcaagcaagcacaatgctgtgttacaggtgttattgtggctaattgtgcagggtgagtggagaagaagtgggttacaaacagagagagggggccagaatattataccttactgtgtcctgttcttcccctccatatcttgggaaggtaaccacagagaatagtattttcttatttcattgcattcaatgatatgtttactacagcttcaaacacattaaaaccccaccatgtggtcacaaaatggcatgcattttgtgtttcctccatatctgaccatgacttggagaaaagtaagctctttagaggatgtattaatagttcatgattattattacaactgctagatataattgatcattatatatatcaacacctaattgatataattagacaactggtctaaagaaaaggttgagctatgcatatttttcctggaattatttaatagagaatgcttaacaaaagaaagaagaaattttactgtatactccctgtgctgtgatatgcattatgtaccttgagcctggaaatcatgaatattaacatttaccataccagctacatgattagtaattacccttccatggtggccctgacaatttattattatataaattttgttatgcacaatatctatttaacctgttcttaaccctttatctcaacctctacctgactactgccttccccagaatctctggcatgaattgcaatggttagagagagtgtaagaactaagtagttttcaaggagatttatcctgactcagtaagcaaatttatagatagtttagaagcaaattttaatgatgtattgcccaacagggacttacaggtgccaccaaacttttgggatgctatgtagttttgctgggctgtcattttaaaaaatgttgcatccctagtggaaaatatttctagaaatactatgacctttccattttttaccatgaaagtgaggtgatctaagagtagccatcttccaagtaaatgtggtgaaactttagtttgaaatattcatcatgcttctgttttgaacagccaaaactctactaaaattcagtttgctggtttattcagcttattcattttatgcaaatctcaatgtgcatgaaatgaacaaaagacttcatttctattcatatgcattgttagttttctattccatttttattcccaaacttgtttttctctttttcagtattagcactttattcattctttcaacaaatatttgtggcatccctagcatgatgaggcaccaaaaagaatgataccatccccgcatggtaatcggcatggcccacaggtttcatcttgaatgcctttttgagtgcactattagaggatgtttggagatttctttaggaaacatctatgatgaaaagaaagaatgatctcaattatgtgtgtccgctatgagcagggtttcaaggccgattgccgtgccaactcagggagtgggaagattgtccaccagggggtcaggcagatgtggattctgattttgactctgctccttgaaagttctaactggggcaagctacctctgattctgagagagattcctcatatgtaaaaggagaatacctgcctcacagtgtggttaaatgagtttccagagagtggcaacaccttataggactccctcaataaatgattgttcttagcacctcttctaggatcctacaatctaatgcatttgtaaatgagcaaaaactttagtaatactgaaacgttggctaaaataagtcccattaatgcagggacaaacaaaatgttttgatttcttggaaggtttgatgaattgtggattgcctgattccttttctctttccaggttttgtcttagatgtaacaagttcctatcatgggagtctgtaccatacaaccacaaatacacaatggtatggagaaagggagagagagaacaaatgagttgtaagaatttaattggcaaaactgattatccatgctgagtttgctcctattgtttttaaagacacatgttttttatactacatggccccaaactcaaaatcactcaaataaacactgatctgttccagcactggaggaaaaactggctttgttagacttaccgagagatggtgtgtttctctccaatatggcacctttctaagggattctcaagggtagttttgataatacatgattattgacttatttgcagtataacacttaccttgactgcacttttttgcttttacacattgtaattcatttcatcttttacttatcttgaatatcaagatttactttctctatctttttttttttcacataagctctgtatgtgactctacctgtttcttggaacaggtagttccaaggtttctttggttacttaatgactattttgttattttatttttccaaaacatgtcatagggttgtgtctagaactcaggtcattctgtataatgtttccagtaggttttggaggttaagatattgtttccttagaaatacctgatcaagatttcatgtccttacagttgcacatataagttttgtagctggagtaagctcagcagtgtttttaatgtcacaatagtaatgtgctccttgcctgttgtattagtccattttcatgctgctgataaagccatacctgagactagccaatttacaagagaaagaggttaattgaaattgcagttccacatggctggggaggcgtctcaatcagggtggatgatgaaagtcatgtctcacatggtggcagcaaaagagagaacgagagccaagtgaaatgggtttccccttatcaaaccatcagatcttgtgaggcttattccctaccatgagaacagtatgggggaaaccactcccatgattcaattatctcccaccgggtccctcccataatgcatgggaattaggagagtacaattcgagatgagatttgggtggggacacagagccaaaccatatcattccacccatgacccctcccaaatctcatgtcctcacatttcaaaaccactcatgccttcccaacagtctcctaaagtcttaactcatttcagcattaactcaaaagtccagtccaaagtctcatctgagacaaggcaatttccttccactcatgagcctgtaaaatttaaagcaagttagttgcttcctagctacaatgggggtataggcattgggtaaatacagccattccaaatgggaggaattggccaaaacaaaggggctacaggccccatgcaagtctgaaaaccagcagggcagtctaatctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcgccgttttagccgggatggtctcgatctcctgacctcgtgatccgcccgcctcggcctcccaaagtgctgggattacaggcgtgagccaccgcgcccggccagggcagtctaatcttaaagctctaaaattatctatttttgactccatgtctcacatccaggtcgcgctgatgcaagaggtgggttgtcatggtcttgggaagctccacccctgtggctttgcaaagtatggcccccctcctggctgcttttgcaaactggcgttgagagtctatggcttttccaggtacacagtgcaagctgttggtggatctaccattctggagtttagaggatggatccctcttctcacagctccagtagctggtgccccagtagggactctgtgtaggggctctgaccccacaattcccttctctactacactagcagaggttctccatgagggccacacacctacaagaaacttctgcctggatatccaggagtttccatacatcctctgaaatctaggtgtaagttcccaaacctcaattcttgacttctgtgcactctcagactcaacaccacatggaagctcccaaggcttggggcctgcatcctctgaaacaacagcctgagctgtaccttggcccctgaagccactgaaacacagggtaccaagtccctaggctgcacagagcagggggaccctgaacccgggccatgaaaccatcttttcctcctagtctaccgggcctaggatgggaggggctgttatggagacctcagatatgccctggagacattttacacattgtctttgttattaacattcagctccttaatacttaggcaaatttctgcagaaggcttgaatttctcctcagaaaattgaattttcttttctattgcattatcaggctgtgcattttacaaacttttatcctctgtttcccttttaaaattgaatgcctttaacagcacccaagtcacctcttgaatgctttgctgcttaggaatttcttcttccagataccctaaatcatctctctcaagttcaaagttccacaaatctctagggcaagggcaaaatggcgtcagtctctgctaaaacataacaaaggtcacctttgctccagttcccaaaaagttcctcatctccatcggagaccacctcagcctggatttcagtgtccatatcattatcagcattttggtcaaagccattcaacaagtctctaaagagtgccaaactttccatattttcctatcttcttctgagccctccaaactgtttcaaaccctgcctgttacccagttccaaagtcacttccacatttttaggtatcttctcagcagtgccctactctcctggtaccaatttactgtattagtctatttttatgctgctgataaagacataaccgagaatgagtaatttacgaaaggaagaggtttattggacttacagttccacatggatggggaagcctcacaatcatggcagaaggtgaaaggcacatatcccatgtcggtggcaagagagaatgaaagccaaatgaaagaagtttcctcatttcaaaccataaaatctcgtgagatttattcactgccacaagaacagtatggggggaactgcccccatgatgcagtgattcagttatctcccaccgggtccctcccacaacacatgggaattatgggagtacaattcaagatgagattttggtggggacacagaatgaaccatattacctgttttttttgctgccaactcaaaggatcttttgtctggtagctcaaggctccaaggctctaatgcacaataaaatgtgaagaccaaagagcaaacaagttctctttatcagttatttacatctctgtgtgcatgaagtgtgctaaataaaggatattggaaagtaggagaaagctgtcctccctgaaaatgcctgggttggggtataagcccagctttcctactttacccctttgccaaggggcctaaaaccatcaaacattctcactctacctctgccctcatttttctggctgtccttctttctttcttttattctctgtcctatggagtattctttctaatattgatttttaattttttaaatcgagatagggccttgctttgtcacctaggctgaagtgcagtggcacagtcatgactcactacatcctcaatcttctaggctcaaacaatcctcctacctcagcatattgagtagctgggaccacaggtgcacatcccacatccagctaatttgtattcttttgtagagatggagttttgtcatattgctccagctggtcttgaactcctaagctcaagagatctgcctacctcagccttccaaagtgctggttacaggtgtgagccaccatacccagcctaatattctttattaataatgacacactgatgattgaagtgtaagatgcaagtaagaggtaaacattttaaaaacatctctaattctcacaataattctgtagggaaaatttttttcatgttaaaagtgaaaaaatctgaaacagaaggagaaaataacttaccatgtaatttagcaaatggtagaaacagatgagaatccatatgtccttttccaccatcatatgctgcctttatttgtacactatacgtgtttgtaaatgtgtgcgtatgagagagaaagtgcatgcgtgcaagcttatcaatctttctatgtatatatacattttttttaaccaagtctgaatgcatagtttttgctgcagtgcccgaaaaccagtgttgccaggttgttcactccgcatgtggcctccctagaatgacttgaaattttataagttgcaatttacacaattgatgcattcttctcttgtatcatttttacagacataacagaatttataccattttatttttcaaataaatgatttccaggggtgacagttgctttaattcttactggctggtctttgaaggcataacattattttctttaacattatttgttccttcctataaggcgcaacactatgctcatgttgtgtccattgaagcagtttctcatttttgaaattttaatgccttatgggatgaaaaaaaagaggagaggaaagacccagtagtgatttaagactatgattccgaattgaagcatcttgctacttagaggaacaccatatttcatagtgtatttgcagaaatgcttcatggcacaaactcctatttcatgtccttgaaggccaatggcgtaacagaatttctgtttcagtgcctatctgatcaataatctccatgacatttcctagttgccatccatcttgtggtacacttttactgtgttgatgtatagtgactaatatctacatgtatatattttttgtctcctgcaactgtaaattatttaaaaaatatttctacaggtgcttacatctatttatataaaacatattttccttgatttcattggatatatatatatatatatatatatataaatttcactggaaaaaatatttggaatttagtgtaattccctttgggcatggcctttgagtaaacatatgtcaatagagcactgtctatgtggcagacaatattctaggcactggtttcaaaaatgagtaggacatggaccctacctttccagagctcacagtcttcataaatctgtggaaacaacatgaaatactgcatagattttgttacctttaggcctcagtttgaattttctttttaccacttgttaggtgctggacattcaatttctcaatgatatcatctgtaaaattgaggtaataataaatatcatcttaaggcttatgcgaggattaaatgagttaataaatatatgcatttacaatgacaccaggcacatacatcccaacaaatcctggatattataattattattgacattagtactattgttgtgatgtaagaaacaagcagctaaagattataatactatataatgaatgagtgtaagatagaaattttttcaagaggataaaatacaaaactcctttgtaagctgtcctaggagacatgaaacaaatgagttgaagaagaccgtattttcactagtcatatgagaaaagttataacactctaggcagcagaaatagcatttgaagagtcaggaaggctgagaaagcatgtcccactaagtaaaatattactgagctcatgtgtataattggggagtagagtatagggcaaagggtaaggtcacaaaaaggtctgggtgatatactaagaatttaggacttcatcatgttgacattggaagccacgaaaggatttttttaaaaatggaactaatataatcagatttacattatagacagatgatcctatctccattacagaggatggatcagaaagaacactagctggaggaaggtaagacttgaggatagaaggctgttatgattggtcatgtgagagctgatcaggttgtcaaataagactctgtcaacggaaatggaaaagttgggatgcatttaagacacatttgagaagctgaatggacagtactggaggatcatttggatgaaaagggaacatagaagaagaggggcatctaaaatgatactcaagttgatgttttgaacaattgggtggatgacagtacttttgacaggaataaagcacagatttgaaaggcagaccagagacacaagggaggttggctggggatgaaattctggacaatcatcaattcaggggctggtggagaaagaaggaacagagaagaagacatgtaataaatgtacaagtaagagaagaaccaagtgttacagaatctaagggagaaataaatgttaaaaaatgtttgttacaaagatggagcaaggtggctaagtagaagcctacagcaattatcccccgcaacaggaacaccaaattgaacaactatccacacacaaaaaagcacattcaaaacaaccaaaaatcaggtgagtgatcatagtacccgaatttaacatcacattaaagaaagaagcaatgaggagggtaggagaaacagtcttgaatcacctacaacacccctcccccattctccagcagtggccatgtagtacagagagagaatttgtgctcttgggagagggagagcacagtgattgtggggctttgtattggaaattagtgctgttctatcacagagaaagcaacatgggggcagaactcaactgttacccatgaagggaccacttagaacaactctagccagagatgagttccaacaagccttgccactgtgggctacagtgctctagggttgtaaataaacttgaaaggcagtctaggccacaagaactggaactcctaggcaagtcctggtgctgtgctggcctcagaactggtggacttggagtgcatgcaacccagtgaggcaccagctgggatggccaaatgagtgcttacatcatcatcaccccctcccccaaacccaggcagtgatgcataggccctagcccctagacaacatctctagacacgcactgggccagaaaggaacccattgcctggaagagagggatctaggaatctagtcctggcaacattcatcacctgctgactagcgaaccctcagataccgaataatcagcagtgatagccaggcggtacttgctgtaggccttaagcaacattcagagccatgctggattcaggtgtgacccagcacatttccaactatgatagctaaagggagagactccttctgcttgaggaaagaagagggaagagaaaaaaggagtttgtcttgcagctttggtactagcttagccacagtggggtagaacacaaaatgagttcctgcagtccctgattccaggacttggctcctagacggcatttctggacctgccctgggttagatgggagcccatttcattgaaggaggagaccaaggcctggcagcattcaccacaagatgacagaagagccctgggatctgggtgaactttggtagtagccaggcagtacttgttatgaacctggggtgatggtgggtatgaggagagactcctctgcttgaggaaagagaaaggaagagtgggaaggactttgtgttgctgcttgagtatcaactgagttgcagtagaataaagcaccaaatggattcctaatgtttccaactccaggccctgcctcctggatggcatctctggatctgcacgggacagggggaactcaccaccctgaaaggaaagaaacaagcctgtctagatttgttacctgctcaacgtagagcccttgggccttgagtgaacataagcagtaaccatgcaagggtcactgtgagccttaggagacacccagtgctgctctggcttcaggtctgatccagtgtggtctgagtggcgggggccacagggatgcttgtgtcaccagtatcccaactccaggcggcccagcaaagggactttgtttagggaaagtaaaaaggagaaaaacaatatctgcctggtaatctagaaaattctcttagatcttacccaagaccaccaaggcagtacctcttcgagtctgtaacagccaaaatattactggaattggggtgtgccctaatgcagatatagctgtattgacaaaagatgtagattataacacccaagtccctttgaatgcctggaaagccttcccaaaaagagtgggtgcaaacaaacccagactgcaatgactacaataaatacctgactcttcaatgaccagacactgacaaacatctggaagcataaagacaatccaggaaaacatggcctcaccaaaataactaaataatataccagtaaccaatcctgaagagatagagatatgcgacctttcagataattcgaaataactattttgaggaagcccaatgaaatacaagattacacagagaaggaagttaggattctatcagataaactcaaccaagagattgaaataattgaaaagaatcaggcagaaaatttggagctgaaaaatgcaattgacatactgaagaatacatcagagttttgtgacagcagaagtgatcagacagaaggaagaactattgaacttgaagacaggctattagaaaatacagtcagaggagacaaaagacaaaaataataaagaatgaagcatacatatgagatctaagaaatagcctcaaaagagcaaatctaggagttatttggccttgaataggtagagaaagcaatatggctagaaagtctatttaaagggatcataacggaaaacttcccaactccagagacagatagcaatatttaagtaaagaaggttatagaagaccaagcagagttaacccaaagtacattatgtcaagacatttaataatcaaaccccaaagatcaaggacaaagaaaagatcataaaagcagcaagagaaaataaataaataacatacaatggagatccaatacttctggcagtacccttctcagtggataccttacaggccaggagagagtggcatgacatagttaaggtgctgaaggaaaaaacaaacaaaaacttttatccttggagtagtatattcagcaaaaatatacttcaaacatgaatgagaaataaagactatcccagacaaacagaatagccattctgaatacacaatgaaaacagaatagctattctgactggtgtgagatggtatctcattgtggttttgatttgtaattctctagtaatcagtgatattgagctttttgaaatataattgttggccacatgtacgtcttctttaaaaagtgtctgttcatgtccttttttcccttttataatgtgattgtttttctgttacaaatttgtttgagttccttatagatgctggatattagaactttgtcagatacatagtttgcaaatattttctcccattctgcgggttgtctgtttactctgttggtagttgcctttgctgtgcagaggttcttaattttagttaaaccacatttgtcaaattttacttttgttgctatcacttttggcatctttttcatgaaatctttgcctatttctatgttcatgatggtattgcctaggttgtcttccagggtttttatagttttggattttatgtttaagtctttaattcaattaaggttgatgtttgtaaatatatggtgtaagaaaggggtccagcttcaatcttctgcatgtgactagccagttatcccagcacaatgtattgaatacagagctttcccccattgcttatttttgccagctttgtcacagatcagagagttgtaggtgcatggtctcatttctggactctattatgattatgtcccattaatctatgtgcctgttttgtactagtaccatggtgttttggttactgtagccctgaagtacagtttgaagtcagataacataatgccttcctcttcattccttttgcttaggattgccttggctatttggactcatttttttgttccatataaattttaagagtttttttctagttctgtgaataatgtcattggtagtttgatagaaatagcattgaatctgtagattactttgggcagtatggccattttagtaatactaattcttcctatccatgactgtgaagtgttttttcatttgtttgtgtcttttcttatttatatgagccgtgttttttaatcttattgtagagttcacctctctgatttcactgtatttctaggtatttattccttttggtggcaattgtgaatgggattgtcttcctgatttggctcttggcttggctgttgttggtgtataggaatagtagtaatttttgtacattgattttgtatcctgaaactttgctgaagttgtttgccagctgaaggagcttttccgccaagactatgggtttttcaagatctagaatcatgtcatctgcaagcaggaatactttgactttctctcttcctatttggatgcccttaatttttttttaatcttgcctgattgttctggctaagacttccaatactatgttgaataggaatggtgagagagggcatccttgtcttgtgccagttttcatggggaatgcttctatcttttgcccattcagtatagttctggtgggtttgtcatgcatggctcctattattttgagatatatcccttcaatacctagtttatggagagtttcaaacatgaatggctgttgaattttgtcaagtcttttctgcatctattgagataatcatgtctcaatcatgtatttttgtctttagttctgtttatgttatgaatcacatttattgacttgcatatgtagaaccaaccttgcataccatggatgaagcatagttgattgtggtggattagctttttgatgtgctgctggatttgaattgtaagtatattgttgaggattttttcatcaacgttcatcagggttactggcctgaagtgtttttgttcttgtgtctctgccagattttggtatcaggatgatgctggccttgtagaacaagttggggaggaatgccttctccccagttttttgaaatagtttcagaaggcatggtaccagatcttctttgtacatatagtagaatttggctgtgactccctcaggtcttggctttgctttggttggtaggctatttattactgattcaatttcagaattcattatcggtctgtttaggaaattatgttcttcctagttcagtattgatagggtgtatgtgtccaggaatttgtccatctcttctgggttttttagtttgtgtgcctacaggtgttcatagcggtttctggtggctatttttatttctgtggggtcagtgataacatcccctttgtcatatctaattgtgttaatttggattttttctcttttcttcttttttaatctagcttgcagcccatctatcattaatttttttcaaaaaaccaaccacagtatttattgatctttataatcattggtgacttaatttcctttagttcagctctgactttggttatttcttgtcttctgctagctttggggttgatttgttcttgagtctttcattcttttagttgtgatgttaggttcttaatttgagatctttctaactttttgatgtggacgtttagtggtatgaattttcctcttaacactgccttatctgtttcccataggttctattatgttgtatcttcattttcattagtttcaaagagcttcctgatttctgccttcatttcattacttatccaaaagtcattccgaaacatgtttaattttcatgtaattgcatggttttgagtgatttttcttagtcttgacttctatttttatggtgctgtggtctaagagagcggttggtatgatttcatttcttttgcatttgctgaagattgttttttgtccaattatgtggctgattttagaatacgtgccatgtggcaatgagaagaatgtacattctgttgttttggggtggagcattctgtagaggtctattggattcatttggtcaaatgttaagttcaggtcttgaatatctttgtcaattttctgttacaatgatctgtctaatactgtcagcggaatgttgaagtctcctactgttgtgtgggagtctatgtctctttttaggtctctaagaacttgctttataaatctggatactcctgttttgggtgcatctatatttaggataattaggtgttcttgttgtgttgtaccctttaccattatgtaatgccatttgtcttttttgatcattgttggtttaaagtctgttttgtctgaaactgggattgcaaccctgctttttttctgttttccatctgcttggtatattttcctccattcctttattttgaacccatgagtgtcattacctgtgagatgcatctcctgaagacaacatattattaggtcttgcttttttatccagcttgccactctacacttttaagtggggcagttagcccatttacatttaaggttagtattgatatgtttggattggatcctgtcattgttttgttagttggttattatgttggcttgtttgtgtggttgctttatagtatcactggtttgtgtatttaattatgttttcgtatgagctggaagcagtctttcctttctatatttcatgctcctttcaagatctcttgtaaggcagatctggtggtaacaaactccctcaacatttgcttatctgaaaataatcttatttctccttctcttaggaagcttagtttggctggatataaaatttttgattgaagatttttttttcttaaggaatgttgaatataggcctccagtctcttttggcttgtggggtttcaactgagaagtctgctgttatcctgatagagatccttttgtaggtgacctgccctttttctctaactgtcattaacattctttcttatatttcaactttggaaaatctgacaattatatgcattggggaaaattttcttgtgtagattcttgcaggagttctctgtattttctgtattttactcttggcctctctagcaaggttggggaagttttgaggaataatatcctgctttctccccatccctttcagggatgccagtgatttgtggttttggcctctttacacaatgccacacttatcagaggttttgtttattcctttttattctttcttctttatttttgtgtgactgtcttatttcaaaaagctagtcttcaagttctgagattctttcctcagcttggtttattctacttttaatatttgtgattgcattgtgaaatttttgtgttgtgttattcaactccattagatccattaggttcttttttgtaccagctatttcatccttcagctattgtattattttcttgtggttcttagtttccttggaatgggtttgctgttctccagaatctcaatgatctttgttcctatgcatattctgaactctctctctgtcattccagccagctcagcctggttaaaaactcttgttggagaactggtgcagtatttggacgacagaaaacactctggccatttgagttactggagttcttgctttggttctttctcatctctgcatgtgcataatccgttaactgcaatgtagatttagtacagtcaacgacttcttttctggatgttttcacgggccaaggctttgtgtaggatctttatttgaagctgacttcttatctttggtttcagagtgggatatgttagtaggcatttttggtgttgaagctttggggtgtgatctagtagatggtacttaggtgtattggtcagttggttgactcttgcttggttgtgtggctcccctatgtttcctcacagttgaagccatgttccctctcagtgctctgaaagtgtgagtttctcttccccttgaatgctggctgcagattgcaacttggcactcctcagctgcccactgcagctctggggtgatctcactgtttatgttccttccccatcttggaggtagcagaggatgagatcttagtagtgtttgtagccaagggtctttgcttatcttctggggggatccaccccagagagatgcaggtcagcaattgcccagtgcaatcagaccaggatggaggttctgtgctatgggcccaagccaggggtttcctgtctggtgatgaacagttggtggggggctaggtgggactgatgggggatggactcctctcctctggttgactgtagcttggaggtatgaataaggcacttagggtctttgtttctttgttagtccaaaggtagcaaggagagttccactgctaaggtagtggcagagaagctttcatttgctctgggggttctttccagggggttgcagaactgttattgacttgatagctctggcagggggtggctagggccccaggcctagagaatctgcccagtgaggagatataggaatgggcacctacataacattctggccatttttccgtaagactgctgtcgtatgctgggggcccactccagttcctagtcattgcaaatatttcagtacctgaaggtattaagagtgaaagctgagaaacagcgaagatgttggcccacgaacatctctgggagctctgtcctagagagttacggacctgttgctggtccaaacactgtaggaggtggctggaaactccagctgggaggccctacctagtgatgaggaatgagatagggcacctttaaaaagcagtctggccacgtttttgtagagaagctgtgttgtatggaatactgcttccacccctggctggtttggactgttcaaagcccaaaggctggatgcctaagttgccagaacatcaaagatatcagcccatccctccctctgggagctctgatccatggaggtttcaaatctctgttggccagaaaacaccagggggaaggctagagaccccagctggaaggtcctgacaagtgaggaggaatggaattgggtacccatttaaaaaagcaatctggcagcattttcatagagcaactgtactctgctaggggaccgcttctgttcctggttggtttgtactctccatagcccaaagactggacagctaagttgctaaaacagcaaagacagtggcctgtccctccccttggaagctctgtctcccggaggtgcaatgctgctaccagtggctggccagaattccaagccattgagtcttatcttgtgaggtgccatgaaagtggggcctgcatactattactcttcagtctcctggattccacccctttcctaggagtatgtgtgggggtctaacatcccactttaccttagttgcagctactttttctggaaggcccagaaagcctggatatctaaggcccctgggtatccgcatgtgcatgagtggctgttctgctgagactctgcatagctatgtgtgtcagctatgtgaaagccctggtggagtgggttcacctggggatatcctgacccaacggttgcaaagatccatgggagaagcatgcactcctggggccacacatttactcaccacttccttgtgttgaggaggttctcctggcttcatgtcactccgtggtgggctgtcattctgccttgcttttctccattttctgtggttcaagttgttgccttgattagtcgcaacgtgtgtacctgcatgtttcattttaagatgtgtatttacttgtcccttctgttcctctccatgagagctatgcacactagcagcctctagtcagccatcttggcccaaggtttcaatgaagaaattgtgaataaaattgaaaaaattcttgaaagaaatgataatggaaacacaacataccaaaacctatgggatatagtgaaagcagtcctaaaaggaaagtttatagcaataagcccatatctcaaaagagtagaaaaacttcaaataaacaacctaattatacatcttaaggaactagaaaagcaagagcaaactaagccccaaactagtcaaagaaagaagtaataaagatcaggcataaataaataaaattgaaatgaaaaaacaattaaaatgatcaactaaacaaaaagttggtttttttaaaaagataaaactgacaaatctttagactaattaaaaaagagagaagacccaaaggaattatatcagaggtaaaaaaaaaaaaaaaaaaactcctatctctcaccatttacaaacatcaaatcaaaatgttttaatgacttaaatctaagaccttaaactatgaaactacttaaaagaaaacattgaggaaatgctccaggacattggactaggcaaagatttcttgactaatacaccacaagcacaggcaaccaaagcaaaaatgaacagacaatatcacatcaagttaaaaaacttctgtatggcaaaaaaaataattaataaactaaagaaacaacccatagaatgggagaaaatatttgcaaacaattcatctgacaagggattattaaccagaatatttaaggagctcaaacaactagattagattattagatgttttctaatggatagtttccaaactattagatgttttctaatagtattggaaaacacctaattatctaattaaaaactggttaaaagttctaaataggctttcctcagaagaagacatgcaaatggcaaacacatatatgaaaaagtgcttaatatcattcatcatcagacaaatacaaatcaaaactgcaatgagatatcatctcatcccagttaaaatggctgttttccccaaaaaaacagtcaatgacaaatgcttgtgaggatgtgaagaaaaggaaactctgaaaccctgttgatgggaatgtaaattagtacaaccactatggagaacagtttggaggttcctcaaaaatctaaaaatagagctaccatatgatcgaacaatctcactgctggatatatacagaaaacaaaggaaatccgtacatcaatgagatgataactgcactctcatgtttattgcagcactatgcacaatagtcaagatttgaaagcaacttaaatttctacaaacagatgaataaatgaagaaaattgtggtacatatacacaatggagtactattcaggtattaaaaaaatgagatactgtcacctgcaacaactggaggacattatgttaagtgaaataacccagacaaagaaaggcaaactttgcacattctcacttatttgtgggagctaaaaattaaaacaattgaactcaggaagatagagagtagaaggatggttaccagaggctggaaatggtagtgaatgtgagagcagggagtagagttggttaataggtacaaaaatatagttaggaagaataagatctagtatttgacagccaacaggatgactgcagtcaacaatagcttattgtatatttaaaaattgtaaaaaaagagtataattatattgtttctagcacaaagtacaaatgtttgagaggatggacacccaatttaactggatgtggttattatacaacgtatacttgtatcaaaatatctcatgtaccccataaacatgtatacctactctgtagccacaataattaaaaatatataaaaaataaaagatttgttaaaattagaaggtaattggtgatctcagtgcatatattctaaagttaagaagaattaagtaaggggaacaaaatgaagattagtgaaaactattgtcaagtagcttgactatgaaggggcatacaaatgaggttttttccctcctctttaggatagactttagtacttttatatgctaagagaaatgagtcaccagaggaagacagatatttaaaaaagatgatataataaataattcctttcaggtgaaaattgtatagaaccagaacaaaaggataaatttttaataagaggacagtgtcctatttatgtacatgggagaaaagaatggggtacatggagatagattgtgtgtgtctggaatacaaattttactgtgttcatatctgatggtttctattcataaagtagaaggtgaggttatcttcatgagtattaaaggttttattctttttccatcaccattatgttttatctaactccttctagaaattatgttgtgtaaacaaaaaggatttaagacatgtcccaatcaatttagaaagtttattttgccaaggttaagtacacgccagtgacaggcacagcgtggttttatacattttaggtagacatgcgacgtcaatcaatatgtgtaagatgtatgttggttcggtccagaaaatcaggacaactaaacatgagaagggggcttccaggtcataggtagataagataaggttgtggctgggcacggtggctcacacctgtaatcccagcactttgggagcccgaggcaggtggatcatgaggtcaggagatcgagaccatcctggctaacaaggtgaaaccccctctctactaaaaatacaaaaaattagccaggagtggtagtgggcgcctgtagtcccagctactcaggaggctgaggcaggagaatggcatgaacccaggaggcagagcttgcagtgagcagagattgcgccactgcactccagcctgggcgacagagcgagactccgcctcaaaaaaaaaaaaaaaaaaaagagagagagacaaatggttgcaatggttgcattcctttgagtttccggttagccttccaatgaatatacaatttacaggaatagtcatatatgctttagtctggcttagggaaacaataggtcaaaggaaccaatcagatatacatttgtctcatgtgagcagagggatgactttgagttctgtctgtccttggtccacaaggaatttccctgtgggcaaattttgtgggagatctgtagctgttttattttctagctatcttatttacgaatagaatgggaggcaggttgcccaatgacagttcccagcttcacttttccctttggcttagtgatttggggatcccaagatttattttctttcatagtagtaaaataaataataagtattttgaagaatctctaggttctgtgaatttcttgaggtatttctaaacaatgtttgtgtctgtcttccaatgaagctttaccgactgaagtgttatcgttagtttcttctatttcgaccctctgcctcttttcttttttattgagagggctgtatagattcctgtaagtgctaacagtcatgctgttattttggtcaaagtcacctgtgtgctctctgagcatattacctgaagaaaaaaaatcaatatttgggatcagcagtatctccaatctgtattctttattaagactcctggaagggcatgtttgctgtcctgtactgaacacttgtcacacctacgtaggtgcttgctaaagtatcactgaaggaacatttctatttatgcaagaactatatttaaacattggattgtatcagatgaatacatggagaattagagaggttaagtacatttcccaccatttcccaattttaagtgaggctatgcctcaaacgttctttgattctccaaagttcaagtttttattctcatggaattgacctaacacccttgtctagtcccaggctttatgctatttaactatagttctgtcttttgcagtaaaacaaaataattctatttgtccttccacagagcaccaccagaaacaactgaatcttattgttagcaaagattaatgagctctgcagaggcagaaagagaacttaattttctaacagcaatctgcagatcggggagatgcagcctttggtgcaaaatgaaagtgggctctgaggacggggttggaaagttggagattataaaggtgcaaacttcagggcaggagaggagaatcagaagaatgaggaacagagtcttgatcggatgaccattaagcccaaatcaccaatctctcttaattggctggttccaggcgattggttggttggctccaggtggtcatttggaggtacgctggggaaatttccagcagtagcctatctcagaactcacaagaggaactggtttgacttgattgtagaaaggaagggcctgtgacacttttacacagtacgtgactgcttctcagtcagctatgattgcttgcttctattttaactttgagcacctcagacatgaggaatccattttgtctttcagctggggacatactttatgatttcccccttttggttgaaacttgccataggcagcattgatgaccaacttatgttcttgttgcatattattgccagagtggtgtagctagctgattggagtccatgtagtccctccctgggacccatgtggctgaggaacttatggccaattcaaagaagttgggccaagtaaggcaagaaggcagataggcatctgttagctctttatcagtgtctcttatggatgtttggtggtatcagttaagtctatgaataaaacctagaagtgtcatgtgataaaaatccatgtcggagaattggcaaaacatttgtaaaacagacaagaacaatttttaaaagaaactagctgcctaggcttcataggagaaggatctaagacagaactgtggatgacaagaacttagagtaccatagttaaagatgcaattgataagataatatggttacttctgtgacatacaacaatttaacataaaaaccataattatgactaataacatataccaataaatataagaatttaggaatattatacaattttggaacacataccggtaacacatttatacaaatacaaatcaaagttaaataccaattttaaaaagttgtcattgtgtcttatatgattttaacatatcaaacaagcctaatatgtctttcttggacttcctggggttcctgttatgtccaagttagttcgggacaaaaaacttgattttagaattttccatttaattttggaaagtttaaatatcaaaggtttaaaattgttgatcaaagtagaattacagatcactaggaaatatagcaaaagagtttaaaggcacaaagcacaagaaattatttggataaaacattaactggaatctctttcctaggtcatttatgtaaaaagtaaagaaaaatctgttttataattttctactaaagaacagatgaatcccctaggaataccctgtttttctgacattatagcccaactctggccttacatcagtgtgcttttatattcataattgtcttctagttttaaccaatttgatcacacaaaattccttccatgggattaatcattaacaaatttttacaatttgtttagtccttttagtttgtcctatattttttgtttttgtttttatttttggcattctatcttaggataaaaatttaccttccttcctcctcattattttgacgacacagttctttctcatgtcaaaaaaagaaaagaaaattacttttgcttttgaactttttttttttaccaaaaacatatttttgaaaatatactctgtatatttttaaatatctcttctatctagtagttttaattacatatattaactacaattttaactcttagtaaacctagttttcagagaaaaacctaaggagtaagtaattttgaactgttttatgttagaatttgtggatgaaaagaattgcataacttttagaatgaaatattttctcaaaattttttgtttattaacacatctacaaatatttagcttgtcaaagtatataaactcaaatatgtttaataattaatgtttctgaattttaacttagatatgacttatacattttatattacttattttaatataacatgaccttaagattttaagttattaaaaataattttgaaactgtgacacaggtaccctttctaatgtcttccccagttggcctgggtcccaactacccatgtggcactgaaagatagatacaaagggcagggcccatctaagtcctgaatttacaaaccaggagtagagctcaggacagagtacggaactgtggagatattgcctggaaaattcaactttttcagcatggtctaggaggggaagttgggccagggagaatgtggccatatttggcttggctctgccttgcagctggtggtccaggcactgaggacatgtcttcagccctcatcatggccacctgtcctctggattctccagaatccagagactgtcttcacaagctcacagcaaaatgggtgcaatgctttgggcgaggccagaaggcaacccttatagctttagctcacagacaaagcaagaaagtatcaaaaatactagagaagtgagagttttatgacctttaaacatctagcagcaacggccaaaacctgtctgaccagtacacccaggaaaaatgtctgaattatatttaatactgataattctgaagatattctaattttattttgacaataattttaaactagttttgtttaccaaatattactaaagtcatatgagctaaatgtatttgagttagtttctatttttctgataaaatatttttagatactttaaaatattaattagagctctttcatatattttggtagcaaaatatcacatacgcataacacatataaacatatagacacacagacatacagatagaagcagaccttatagatttataagagtcttcattttctagtattcaaatagtttttctcctccttatagaatattatatcctaaatgattgttagcaaggcaacttaaaatttgtacttccaaagatgtaacttcttatatgaaaatttaaatcacaaaggcttagatctaaacaccattatttgctgagacaaagaaataggtaaggcctagtcaagacaagattgccaggaaaagtatcttaaacaaaagtaagggttgttatacaaatttaagccaatgtcttcgccattgtaaaagtttctagttgtttacgtgcaagaaggaagatgcccttataaatgttaattttttatagaacagatttcttttacaaagactttcacaaactagccagctaaatgtctgaaagtatttttgagaccagtctagttaaataggtgtgtgatttttgtttgttggtttgtttgtttttaaccttagtttatttcttgattggatacctgacttcagggtagagccctttaataaggcaaaatacaaaacaacaataacaataacaacaacaaaacattttccatgcctggtcttagcatggatagctctaaaaaagaagcagttctatctgatgacctactgtttataaataccttatctagtatttctttctttcttttaaaccaaaggtaccttttctggtaactcaacaaaaccagtaagttttaaccaaggttatgactgaaatgaagatgaactagggatctccaaagagatgaaaagcagttttcacaagatccaaaaccatcccaaaggtagctcaaaggtaagtctcattagccacaaataaaatacaactcacatttctgtctggccatattttctaggttcacagcttcttagctgagtgcctgtgcaaaaaggcccataaaccctgtgtgccccacagacagaaaaagacaaaataaaattctgtccatgagagagaaaaggatcaataaaaatgggcaacctgaaaggccaagagtcatgtatgtaatttaaaacaaatggaactggtttcctgactgggcctcaatcctggaccatagccattaatcacagaatcttagccattagactatagtgtgaaacgctttttgtaaatcctgctggggatccaaagcaggcagtatgagtgtacaaaaaattttaactttgctttaggtaatagttttcctctttaggtttgtcaagagaatttctaagtcaactctgacactattatgtgtgtcttcaaaaaaaaaatattttcataaatgcaaataaggcaattgcttaaaatgagatatttctactttttttctatttttaaatttaggagtctagtttaaaagatccatcttctggccattcacagttagaattcctaacggtgtgcttactccaatatcaactcaacccaataggcttttcatggaaatttcaggatgtagttttccaggtttaggatacacctttctgagttaagaaagaggtgtttactggagcaggcatagaagagacaatctcaaagatagttgtgtgtatgttgcctctggtaacccacaatttttttgggtccactagtcacagacccattaatctatgacacttggtaggccctcctggaattggactttcccagtaccaatcaggcaacaagggtttagatgactaaagcccaatagggatgggctttcctgagagcttgacacattcagaaaatgtttttaaaaagtgtgttaataagaactgcaaactgaagagtctgcaggactggcttgaacaaatggtcttttaggagttttaggctcatgttgtaccctatggttctctgctttattacagaacaacacaaaaacacaaagacaaaagaaaagacaatctgggagacaaaagattttaaataatatgaatattcatatcaaaaagtagcatacaacacaccagagtcactacatccaagactagtcatacaaatcattttctccaattaaaaaagattttgtggaggagacagtgatttttactgtctgtctgcttgactgaatttcacagaaagagaagccagaagccctactggtaagcaattcttacctttctgctggcttatcaggtctcaggttaccttcactgcagctcccagaagagcagaggggctttggtcatgctgctcatagtgtcaaaactgtaggagtagagggaaagcttcccctttgcccactgaaggttcaagtaataatcaactcacaaagggaatccataggagaagtggcatacaaatttattaacttgatcacagggaataaccccagagttattacctacttcttgataaatgaaaagtctcaaggaaaaatccttctgtcaagtagaacaactagctggatataataactcaggactgtcaaccaaatgggaggaccaagactcaggaaagactcacccagccacctctaagtgtggaggagccactgtgagtcctcataatgttccagaagaagaaggtggtggtgagaaggggaaagtgatgggcggggggcggggtgagatgcaagtaggggagcagggagacacagggtgctttgttttaaggtctgagagcctttcatgttttcacagatgttggttaagtcttcagatttgtctccttttacaatttacagaggttccaattgtgtttggagctttcaaatattcaaattaaagaaaagactcatttttgagaagtcagacttctctttgttttagttttgtctgtagatactacaatttagatgcatttctcgggtcaattattatccaacctttgttttaagtttgaaaaaccaccagagtgcctgatggtggccagtcagagactgttcctttagaatctgggtcacccataacactcactttatgaaagtgcccctttgaatgcagctgaagtgtaagtgtcctcacaaaactgaattgtgagtgtaccttacaaagtgcaagcatatccccgaagtgtgggcatactctattaatggctaccccatagagctggatgggcagacttcctaaagaaaataaagtctccaaaacttcagcccaaaaatgggagaccttagattcgaaaagccttgcccaattcctccccgatgcagccaggaagtactgaacataaggggctcatgtaggcacctatgccttggtccaactggcattgggaaagaggtttggggccacttcagatcccatcctcctcatcaacaaacgttaacaaaagatcaatgagacctgcagaggcaaaaggagaactttattttcaaaaagcaatctgcagatcggggagatgcagccttcagtgcaaaataaaagtgggctttctgaagagttttggaaagttagagattataaaggcaaaaactgcagggaagagaagaggagtcaggggagtgagggacacagccttgattggatgacctttaaaccccaaatcatgtcttccttaatcagctggttccaagtagttggttggttggctccaagtgctctgttggtgatatgttgggggaaatttccagctgtagtctatctcagcactcacaagaggaactgtttggcttgattgtagaaagaaaagtcctgtgacacttttataacatcttactgagaacacagagtacatgaccacccctcacccaggtagggctgtctgattctatgttaaatttgagcacctcagttagccatggggagtcccttttgtctgtcagccaggcacgtactgtaataccatatttgtctttctgatgcatatcatctttaactaccttgagttttccttgaagataatggtttgcaaactctttcaatatcctggcatcctctgtgaataaactttagttcttagtcttagggaagctctcataaaataaaaataacatgaaattctagctgagattgagttttgttctgacaaattccaggatttgaaacctgaacaggacacttagtctctgcatctcttttattcatttgcagatgaaaatggcacctaagccagcacaaggtttttctttttaaacaggtttattagtgtattataaagtgcaacatttcaaagtatacagttcaatgttttttagtacacagttggctctccatgttcccaggttctctgtatccacagattcaaccaactatggatcatttacagtgttgtgcaaagaacaccatgatctaattttagaacattttcattctccctacaagaaacactgtagccattagcagtcactactcaccacccccagcttccttccccaccccaccttatcctcagtgctaggtaaataccaatctgctatcttttgaaatatatttgtctgttgtgtgcatttcagaatagataaaatcatataatttttcttcttttctaactggtttcttttacatagcctaatgttttcagagttactccatgttatagcatgcatcagtaattcattttatagccaaccaatatacattgaatggatatgatacaatttgttcatcagttgatggacatttggattgtttccatttttcagctctaatgaataatgcaactctaaacagttgtgtataggtttttatgtggacatatgttttcatttctctggagtggaatcgtaggagtgaaattgcttcacatgataattatgcattcgtatggtaactctatgtttaacattttgggaaactgccaaactgttttccgaagtgactttaccattttaaattcccaccaatgagcattttatgagaactaaaagattgagttaatagtcagaggaataaataaatgcttaagcactatccatagttattcttattatcttgttttgtctaacttctcccagaaagcaagcagcatgtgtgtgtgtgtgcgtatacgtgtgtgtgtgtgcatgcgtgcacattttaacaaatctcccagtcatcttgaggatttctttaggtaattcctagagttaatgtttgtggcttatgagctcatgttttgttattaaggctctggtgaggcaaagaacagatgtgagtctggtatgttcaaattagctctccagttacctacttgcattgtaactatcctaaccttggccagtcatctctcaggaacatgccaatgatttcacacatgtggatcagacagcagttgtggtcagtctgactaaagaaatgactgggaagaaaatttattctgtttgtcccagagatggagggtgatttgtgctaatttacaggtaggacaatactaattacactgacagaaccgagtactaccaagaagttcatgagcacatgactcagagaaggagcttgtccttcactgtctctatttcatatgagactgcattcttagaggcaagaatcacatcttagcctgttactgtatagaagtacatatggacatagtaatacggacatagtattacataatcaaaataggaaattctatacctattagaaatatatttcatttgagtttatctatacatatttagaacacaggaaattactttttactaaacatttagctttgtcttaaatatttctcatctaatatccaaactattcaaagtacttttttattttttaattttcattttaagttttagagacagggttttaccccctcatccacattggagtgcagtgatgtgatcatagctcactgcagcctcaaactcctgggataaagccctccctccttagcctccagactagcagctaggactacatgtacatgctgccacgctcagctaggattttttttttttttttgtagagacagggtctcactatgttaaccaggctggtctataactcttggcctcaagcaatcatcccaccttggccccctgaagtgttgggattacaggtgtgaaacactgcacctggccaagaaatactttttattctctttattacagatgaacaaaactaatactcaaatcacctaacacccagttcctaggatagatgagcaatgagcactcactaattttttcaactattaaaccaaagaaataagcaagaatacgtagtcactttgattttaaaaagatgtttctattttaatactttatgtaataggaaattattcttagtgacaagccttattaaatatttaggtagaaaggtttatttagaagtatttgcccagatcaattttttttaatagattattaaggtaaaaggattctaagattagatatggagataataattttcgataaagattgatttgagacactctaaaatttcccaaaatacataacccagagccttatcaattatacaagggtcttcagtggtgttcctgaacacatttggtggacaagtctacaaaataaaaacacctcagatcattcatctaattcctttggttaaatatctcttttttgaattcccaacccttgaccacaccacccttagagctttgctgaaattaaccagcccttaccttcctggttataagtgtccttgtaccctttctggagtgatattaagacaaacaatcagttttcaataataaatagaggatacatcagtgtaaggatgtctagtcaagggtaaaggctaaaggagagtacaatccagtaaaccgcttttacaggatggaagtgaggcatggaaaatatggtaaggtcatcacaaaatttattcactgaatggtcactgtatacttacggtgtggcatggttattatcatgtctatcataggactattaccatgtctatgataggactacagctgtctgaacaaacgaagtaatggttcaattgtttaacttctatttagatttatttatttatttatttatttagttctatttgtttcagttctatttagttctgtttgctgcactaatctggcaatacccagagcgtctccttctcagaagaaccataagttctctcctctgagtatctgaggcatcagtaccagagaagctgtgtccctttggtctaagtcccagctttgtaaagttcccctcagaagcttctaaatattgatagttccattcttctcctttgtttccccaatcttagggtggtagcttcagttactgcttctgtgatatctttgtgttctcttttttcttttcagtttttaaatacccgggtaacagttctttttgttaaattcactctattaaaatcacttgaatattttctgtcttctgattagaccctgatgattacaatcacagaggagtagactatagtgtatgggtagttgataggtcttttcagatactaacacttgaatgtgaaagaaaataaattaaatatatttcactgtgctgtcttctttatatttccttcttgaagagtctctgcccttatattttactaccattaatagtcatattctggaatgtgtgatcatggccacagctgactggaccacagtgggcacattacttagggacaacagattccaggctgatcaattgtctttgacagtgtttgacataaagtgctctgcccaaagatagatgagctgagccactgagccaaaaggattctttttcggtgatttttgaaccaagagtcccagttcaaagctggaccaaaagaagcatacaatgctgctaaatcagattaatggcagagcattagtagctcatgaattattgccgtggagtttttcagagacacttgacctatgaatcactcccttttaccctcagcaaaagcattttcataattaagacttggtttattttgcaagatagatatatccttgtcatttgaatgttcaagcagataattgatggctgtcaactttgttgtggaggggatttcttcaatgaaagctttcaggatagaatataagatgtgtatgtatttctgggctttgctctagacccactgaataaggatatcctaagaatgggttcaagtcatatacattaaaaatagcagtaataacaataagaacaactctctcctctaggtaatgctgaagttgatcaacaagacgtggaaggaaaagaactatatggctattctggctatcaattgctgagtgacaaactatcctaacactcagtgtctcaccatttttattatatctcatgactttctgtgtcatgaattcaagcaggtttctgctgagtgattcttcagtgccatctggcatggagtagggtgaatttaactagatgctagtttcatctggagcatacaagatagcttcactcatatgcctggtgtcttggtggggacagctgagctgctcttcctctctatatagtttctgaacatctgcttgtagttttgccagcaggggagttgaacatcttatgtggttgcttggcgtcctgtggtggctaaggacactcgcatgttaacaatcctcttaaagtgtaggcttgaatctggtatgtaacactttgagtgttctctactggttaaagctgttaaagtgcagcccagatttgatgggagggaaaataggccccatctttcaatgagagaagagttaaagaatttgtggccatctttaatccattactatgacatcttaaagtattgtaaattatatctttaaatcctgagagaatggcatataagaaggacaattacaagatctggaagtcataagaagacagccagcgagacagggcactggtaggcaaagtgatgactggtgtgttttctgttagaaaaagatgcacaggatgacgaaggaaacacaaacagaaggaagtgcaccggggataattttaccgtaggcagagtattatttatgacttttctaatcgtaatagcccactgggatactatggcaaagaatttgagtctgtaggttatttgtgaattggaagtgggtattctttgctaaattgtcaccaaaggtatgaaagtaaatgctatcaaccacgagtaatcatgatagcaacaattatactaataaattcaactgacattttttcaagttaatatgaatatatgcattctttccattgaaataatctacatctttaactgagaaggaaagaaaggagaaatgtttaattaacagtcttttaggccaggtatggtggctcatgtctggaatcccagcactttggggaggttaagttggaggattacttgaggctagatgttccagaccagccagtgcaacatggtgaaaccatatttcttcaaaaaataagaaactagctgagtgtggtaatatgcgcctgtagtcctagctactcaggaggatgagggaggaggatctctagggccaagcagtttaaggctagagtgatgcagtgagctataattgtgctacagcactctggcctggatgacagagtgagatcctatcttaaaaaaaaaaaaaattcctttagatttttaaaagttatcacgatattgattcttcctatccaggagcatggaaagtttttgaatttgtttgtgtactctcttatttcctttagcagtggtttgtagttctccttgaagacgtccttcacatcccttgtaatttgtattcctaggtattttattctctttgtagcatttgtgaatgggagttcagtcatgatttggctctctgtttgtcttttattggtgtatagaaatgcttgtgatttttgcacattgattttgtatcctgagattttgccggagttgcttatcagcggattttggactgagatgatggggttttctaaatatacaatcatgtcaactccaaacagagacaatttgacttcctctcttcctatctgaatacactttatttctttctcttgcctaattgccctggccagaacttctaatactatgttgaataggagtagtgagagagggcattgttgtcttgtgccagttttcacagggaatgcttccagcttttgtccattcagtgtgatattggctgtgggtttgtcataaatggctcttattattttgagatacgttccatcagtacctagtttattttttgagagtttttagcatgaaagcgtgttgaatttttatcgaaggacttttctgcatctactgagataattgtggtttttgtcattggttctgtttatgtgatggattaagtttattgatttgcatatgttgaaccagccttgcatcccagggctgaagccaacttgatcagggtggataagctttttgatgtgctgctgctttggtttgccagtattttattgaggattttcacatcaatgttcatcaggatattggcctgaaatgttctttttttgttgtgtctctgccaggttttggtatgaggatgatgctggcctcataaaatgagttagggaggattccctctttgtgtattgtttggaatagtttgagaaggaatggtaccagctcctctttgtacctctggtggaattcggctgtgaatccatctggttctaggatttcttggttggtaggccattaatcactgcctcaattttataactttttattggtctattcagggattcaccttcttcctggtttagacttggaaggctgtaagtgtccaggaatttatcaatttcttccagattttctagtttatttgtgtagaggtgtttatagtattctctgatggtagtttgtatttctgtgggatcagtggtgatatcccctttatcattttttattgtgcctatttgattgttctgtcttttcttctttatttatctggttagcagtatttatttgttgatcttttcaaaaaaccacctcctggattcattgattttttaaagggtttttcatgtctctatctcctttggttctgctctgattttagttatttgttgtcttttgctagcttttgaatttcttcgctcttatttctctagttcttttaactgtgatgttagggtgtcgattttagatctttcccactttctcctacgggcatttagtgttataaatttccctctaaacattgctttagctgtgtcccagacacagctttagctggtacattgtgtctttgttctcattggtttcaaagaagttatttatttctgccttaattttgttatttacccagtagtcattcaggagcaggttgttcagtttccatgtagttgtgcagttttgaatgagtttcttaatcctgaattttaatttgattgcactgtggtctaaaagactgtttgttatgatttccattcttttgcatttactgaggagtgttttactttcaattatgtggtagattttagaataagtctgatgaggtgctgagaagaatgtatattctgttgatttggagtggagagttctgtagatgtctattagatccacttggtccagagctgagttcaagttctgaatatccttgttaattttctgtctcgttgatctgtctaatattgaaagtggggtgttaaagtctcccactataattgtgtgggagtctaagtttctttgtaggtctctaagaacttgctttatgaatctgtgtgctcctgtattgggtgcatatatatttaggatagttagctctttttgttgcattgatccctttaccattatgtaatacccttctttgtcttttttgatctttgttggtttaatgtctgttttatcagcgactaggttggcaacctctactttttattttttgctttccatttgcttggtgaatattcctccatccccttattttgagcctatgtgtgtctttgcacatgaaatgggtgtcctgaatacagcacaccaatgggacttgactctttatccaatttgccagtctgtttagttggggcattttgcccattaatatttaaagttaatattgttatgtgtgaatttgatcctgttattatgatgctagctcattattttgcccattagttgatgcagtttcttcatagtgttgatagtctttacaatttgatatgtttttgcagtgactggaacgagtttttcctttccatatttagtgcttccttcaggagtttttgtaaggcaggcctggtgttgacaacatctcttagcatttgcttgtctgtaaggattttatttctccttcacttatgaagcttagtttggctggttatgaaattctggttgaaaattattttcttgaagcttgttgaatattggcccccactctcttttggcttgtagggtttctgcagagggatctgctattagtctgaggggcttccctttgtgggtagccaggcttttctctctggctgctcttaacatttttccctgcatttcaaccttggtgaatctgacaatcttgtgtcttgcggttgctcttctcaaggaatattgttgtggtgttctctgtattttctgaatttgaatgttgccttgtcttgctaggttgggtaagttctcctggataatatcctgaagaatgttttcccacttggttccattctccccatcactttcaggtacaccaatcaaacatagatttggtcttttcacatggtcccatttttcttggaggcttcgttccttccttttcattcttttttcctctaatcctatcttcatgccttatttcattaagttgatcttcaatctctgatatcctttcttatgcttgatcaattcagctgttgatattcgtgcatgcttcacaaagttctcgtgctgtggttttcagctccatcaggtcatttatgttcttctctaaactggttattttagttagcaattcctctaaccttatttcaaggttcttagcttccttgcatgggttacaacatgctcctttagctcagaggagtatgttattgcccaccttctgaagcctacttctgttaatttgtcaaactcattctccatccagttttgttcccttgctggcgaggagttgtgattctttggaggagaagaggcgttctcatttttggagttttcagtctttttgctctggtttttcctcatctttgtggatttatctacctttggtctttgatgttgatgacctttggatgggttttttttgtgtgtgtggacatcctttttgttgatgttgatgttattcctttctgtttgttagttttccttctaacagtcaggcccctctgctgtaggtcttctggagtttgctggaggtccactccagaccccatttgcctcggcatcaccagcggaggctgcagaacagcaaagtttgctgcctgttccttccgctggaagcttcatcccagaggggtacccgccagatgccagctggagctctcctgtgtgaggcgtctgttgaaccctgctgggagtcgtctcccagtcaggaggcatgggcgtcaaggacccacttgaggaggcagtctgtcccttagcagagcgtgagccatgtgtcggtagacccgctgctctctttagagccagcaggcaggaacgtttaagtctactgaagctgctcccacagctgacccttcccccaagtgctctgttccagggagatgggggttttatctataagcccatgacttgagctactgcctttctttcagtgatgccctgcccagacaggaggaatttacagaagtagtctggctacaggggctttgaggtgtgctccacccagttcaaacttcctagtggctttgtttacaccctgaggggaaaaccacctattcatgcctcagtaatggcagacacccttcccccgcaccaagctcaagcatcctaggttggcttccgactgctgtactggcagtgagaagttcaagccagtggaacttagcttgcgggactccatgggggtgggatcccctaagctagaccacttggctccctggcttcagccccctttccaggggagcgaacagttctatctcactgacgttccaggcaccactggggtatgaaaaaaaactcctgcagctagcttgatgtctgcccaaactgccgcccagcttcgtgcttgaaacccagggccctagtggtgtaggtgcctgagggaatgtcctggtctgagggttgtgaagaccatgggaaaagcatagtatctgggccagaatgcattgtccctcacagtacagtccctcacagcttcccttaactaggggagggagttccctgaccccttgcacttcccgggtgagggaataccccaccctgcttcggctcgccctctgtgggctgcacctactgcctaatcagtcccaatgagacaaactgcctacctcaggtggaaatgcagaaatcacctgccttctgcattgatctcgctgggaactacagaccagagctgttcttatttggccatcttgccattcatgaaaatggccatactgcctaaagtaatttatatattccatgctatctccatcaagctaccattgactttcttcacagaattagaaaaaactactttaaattttatatggagccaaaaaagaccctgtatagccaagacagtcgtaagcaaaaagaacaaagctggaggcatcacgccacctgacttcaaactatactgcaagactaccataaccaaaacaggatagtactggtaccaaaacagatatatagacgaatggaatagaacggacgcctcagaaataataccacacatctacaaccctctgatctttgacaaacctgacaaaaataagcaatagggaaaggattccctatttaataaatggtgttgggaaaactggccaaccatatgcagaaaactcaaactggacccttccttacaccatataaaaaattaactgaagatggattaaagacttaaatgtaagacctaaaaccataaaaaccctaggagaaaacctaggcaatacctaggtatgagcaaagacttcatgactaaaacaccaaaagcaattgcaacaaaagccaaaattgacaaatgagatgtaattaaactaaagagcttctgcacagcaaaagaaactatcatcagagggaacaggcaacctacagtatggttgaaaatttttgcaatctatctatctgacaaagggctggtatgcagaatctgcaaggatcctcaacaaatttacaagaaataatcaacccatcaaaaagtgggtgaaggatatgaacagacacttctcagaagaagacatttgagcctggcatggtggctcacacctgtaatcctagcactttgggagaccaaggcgggcagatcacaaggtcaggagattgagaccatcctggctaacacggtgaaaccccgtctctactaaaaatacaaaaaaaaaaaaaaaaaaaaagaaaaaaaattaccagggcatggtggcaggtgcctgtagtcccagctacttgggaggctgagacaggagaattgcttgaacctgggaggtgagggttgcagtgagctgagatcgtgtcactgcactccaacctaagcaacagagtgagatcctatcttaaaaaataaatataataaaataaaataaaacaaaaaaacaaaagacatttatacagccaacaaacatatgaaaaaaacctcatcatcactggtcattacagaaatgcgaatcaaaaccacaatgagataccatcacacaccagttagaatggtgatcactaaaagtcagaaaagaatagatgctggaaaggatgtggacaaataggaaaggtttttacactgttggtgggagtgtaaattatttcaaccatagtggaagacagtgtggtgattcctgaaggatctagaatcagaaataccatttgacccagcaatcccattactgggtatatacccaaaggattataaatcatgctgctataaagacacatgcacacatatatttattgcagcactattcacaatagcaaagacttggaaccaacccaaatgcccatcaatgatagactggataaagaaaatgtggcacgtatacaccatggaatgctatgcagccttaaaaaaggatgagttcatgtcctttgcagggatatggatgaagctggaaaccatcattctcagcaaattaacacaggaacagaaaaccaaacaccgcatgttctcactcataagtaggagttgaacaatgagaacatggggacacagggaagggaacatcatacaccgaggcctgttgagggctggggagctaggggagggatagcattaggagaaatacctaatgtagatgatgggttgatgggtacagtaaaccaccatggcatttgtatatgcatgtaacaaacttgcacattttgatcatgtaacccagaacttaaagtataataaaaaaagaaactatttttaaatgacatcataaaacatagtagtgttactgttataatttttcttggaagctgaattgattgcatttctcccattgtaacttaagtcttctagatttcctttcttaaagatagaacaagttattctttctgaaatatataaagtggcaaacttgctttcttctttctttgttttaaaattatttcacaaattgcatgtgtgagatatgaatatgctgttggtgttatttacatttgagagcagattaaatatgtttttgtttatattaattatgaaactctagcattggggattgctatttggttttgttttactttttatatattgaatttttattcttggtaagatttgattattactttgctccaagctgctgagttgctcagaaatgaaattgacacggactccttagtatcagatatgttgatttgaattaacaacacagaagggtgtttaaatgaaaatgtaatgtcatttagtaaattaacatgtggaaataaaaacctcggactaaaatctaatttaacaaagtttcttgaagtttgttttgttgaattaatgactgggaaactaagttcattttgttgataatctctcaatgcagtaataatactaaagttgtaagagcaacaggttacatcctaaccaggtctcctctgcctcaagtacagaatctccaatctatctataacactgttttcctggcagctattctactggcaaactgaacagatcaggaaagtaattatctcttatggaaaagtcatctattttctctatggattatgagtaagggacaccttttgtgcttcatctaaaatctgaaagtaaaattgtactctctattccaaccactgctgcaccaaccagttctgcataggtttccagcactttcatgcacatgaacctgacagcatcctaccccactgcatcttggcgcattgtttggatttgagctgagtgcttccattcctggcctacaaattatctgatacgacatcatgggtgacctatggggactacgttctatttgtgtgtgtgtgtaaactaaaaatttggggatgggagctgattggtaaaagccccccttttttttttgtttttttgttttttgttttttttccagtggacggatggtggctagatacgtttcttaaccctttccggtgatcactgagggatggagcaaccagtttcccatagcagagaacaagtacatacatttattggcttgatttttttacttcactgttttattcttgttcctcagtcctgctttctgggattacattcatgaataaagtactcacacataaacccttgtcttagatcggcttttgagaggaccagctctaaaacaagccctgtaaaacttgtttctgccacttatattaccaggaatgtgttggaatttaattaggacatgtttcctcaaaattgcaccaggagtatcacaataaatgaaacttggtgttcacacagagtgccatctatctttatctggttttagtcttctttcagctggtatatctatgacctttgttctattggcacacaaacaagaacttttggagaaatagtgcttgcttatgaagttaaatgttggagaaaggtattttgaactttggatgtctggaaatttttaattaaaattttagttaattttaatttctccccaaacaatagattggcattgtctgatgaaaatcacaccatattttcttctctgtgcaatcctaaatattatacatagaagaaataaactttagtttgagccagggtttaagttggagatggctcgacttgccaattttgcaaatcaccaaaatttctttctcaaacccaattctgcatcctgtaatttcagttttttccaagtgttatgtagaagatatcattctaagaataaaaatagtcgtgaatgtacatctggaataaatacatatataactcactgcggtaaagctttaaaaggccataggctaaagtatttatataatcctccaaattataaaatggtcaccctagtgatatatgggtagtatagcactttatttatatagttttacaatttctttttcatgttattaaatatattttagagaacagacaacttgaagtttaagataattatatagtttcttattttattgagagatacaagagaattttgaagtttagggctgaaaaccaacatctcagtcacctagaacatttgaatttattggttgatcagtgtgacggttgagtgtcaacttggctaggtgtggtggctcatgcctgtaatcccagcactttgggaggccgaggcaggcagatcacttgagcccaggatttcaagaccagtctggccaacatggtgaaaccctgtctctactaaaaatacaaaagttagccctgcacagtggcccatgcctgtaatcccagctacttggtaggctgaagcacagaatctcttgaactcaggaggcggaggttacagtgagccaaggtcgcaccactgcactccagcctgggtgacagagcaagactctgtcacaaaacaaaaacaaaaaaagtaagtgttagcttgattggattgaaggatgcaaagtattgttcctgggtgtgtctatgagggtgttgccaaaggagattaacatttgagtcagtggactgggcaaggcagacccaccctccgtctgggtggacatcatctaatctcctgccagggcagcaggaataaagcaggcagggtaagatggaagagccaacttgctgattctttggccttcatctttctctcatgctggatgcgtcctttccttgaacatcagactccaagtttttcggcttttggactcttggacttataccagtggtttgccaggtgctcccaggcctttggccacagactgaaggctgcactgttggcttccctccttgtgaggttttgggacttggacttatttaccactggcttccttgctccccaacttgcaggcagtctatcgtgggactttaccttgtgactgtgtgagtcaatcctccttaataaacttcctttcatatatacatatatcctattagttctgtccctccagagaaccccaactaatatggtcagatttctggctatttgaaaaacttaaaacattatagaactcagaaaatgacagcatagttggtagattataaagaacatttgaaaataagtataaaaactattgggaagaataatactgaaaattaatattaagtattttataaactaggcactgagataagcactttatagggaggtgttattattagttccttttattttttcttttgatacattttagatttatttttgaaattgctagatgaaatcgtgtgtatttattttgtacaacatgatgttttgaagtatctatattgtggaccggttacatctagatcattaacatatgcatcacctcatacagttattttcccggtatgaacacttaaggtatgcctctcttagcgtttttcttttttttttaatactttttttgtggggggaggtggggtctcattctgtcacccaggctggagtgcagtggtgtgatcacagctcactgcagccttgaactcctgggctcaagctattctcttgcttcagcctcctgagcagctgggactacaggcacataccaccacgctcagctgattgtttaatttttttgtagagatagggtcttggtatgtagccaggctgatctctatctcctggcctcaagtaattttcccatgttggtcttcaaaagtggtgctggaatcacaggagtgagccaccatgcctgggaagcatttttcaataatacaacatgtcatcctaaactatagtcatcatgccatacaatagcactggtgaatgtattcttcctatctaactgtaattttgtatcctttcacatatttgcaaatgcctccctcccacccccaaccttttcagcctctgataattatcattctactctatattcctatgagatcaattttttatgattttatatatgagttagattatatggtatttgtccttatttgtctgatttatttcacttaacataatgtcctcgaggctcatccatgttgttgcaaaagacaggatttccttcattttatggtcaaatagtattctattgtatatttataccacattttctttatccattcatctgttcatggacacttagtttggttccatatcttggctattgtgaatagtgctgcaataaagatggggttgcagttatctctttgacatatcaatttcatttccttagtgtataaatccagtagtgggattgctggatcatgtggtagttctattttcagacttttagatgtgggaatgtaacactgtccttcttacactcttcaatttatcttttattattttgctataaccaggtactatgatctccacctgaattcgttagctcttatgaaggcatttttgtgcatggatggatgttcaaattgatgtttctgttggggggatgatagctggagagttctattttgccatcttgctctgccttcctgttagtccctctttaaagatgaaacaatattgaaactttaagaaagttaatcaatttgcttgagtttattattgagctcttaagttgcagaattgaaatggccatttattttctgactccagttctgatactctgaacggctgcttccctagagaaggcccaaacgtgataccactctccccaggacaatctgattgtgtggtttgctgatcaaattgactgttggtggctgtgaaagctgactcatctgaaacaaaagctaaggatcgtaagagaacactcagagaatgaaaaagcgtcataagatccaggggtcaaagagaaagaaacatagagagaagaaaagtggaaagaaaatagaagtgagaaagaaaaggagacaagtttctattaaatagtataaatggtagcagaatgtccatggcaatagagatttttaaaaaaatgatagccaaatttgtgggaaagaggtagggttatactgagcagtggtaagtggatctattactatattactggatgatagagtacaaattaatagtggatttttaattccatacattgaccttcctttatttaagaaagcagagagtaagacagtttttattagacagagtctgatgcctgttttcattatatattagaaagcttcgtcacacagaaagttatccttcagatacctgcaaatttgtaccacagcaaatagcactttctttagtgattctgatgtttaggtgtcatgattattcaaggttcttggcatagaaagcatcaggaaatctttgatatgatgcttcaagacatcctgtatttccaatgagctagcacttagacatttatttcttaaacaaatgtgactcttggaagtaatctttctatttttaaatattcttttgatagaaaaatttatatttcagccacagtaaatgtctgactattggaagctttattatttatttaaagttatataatattactattaataaacattaatagtagtgtactctaaactttattccattttttctctcagaaagtcattcctgaaatattagttactgtatgtagatcaattatattccctttgatggattctttgggttttactttatgaatataacacatattatttattaacttcctcccatggtttcctgttccctgtgcacttatgtaagtgttcctctggtatacatacctagaaactggattgctatgtaagaaattaaatacatgtattattttactaagccctaccagattatactcaaaatatgtacacacatttgcagtactatcagcagggcagaggcaagatttcataaatattctctatatgctatttaatatgcaatttctacctatttagagatataaaaggagacattgttattctattttacatttctcttattagcaaaattgaatatttcttgttacaattagtagccatttgttgctttgtccttctctgtcttacatatttattgttttgttagcagttttcaattggatttcctgatttgctcctgctaatttatggacatgatgtgtattatgttctttacttgggtaattcatacggcgggtagcttcgttaagatttttacttatctgtctggttacattatctacagtgtacattactcgagggaattttgaatgtgatttagtaaacccatcaactttttaatttccttttgatacatgcttctagtcttttcaaaaaatatttcccagcctggcgcggtggctcacgcctgtaatcctagcacttcgggaggccgaggtgggcagatcacttgaggtcaggagtcaagaccagcctggcaaacatggtgaaaccccctctctactaaaaatacaaaaattagctgtgcatggtgacgtgggcctgtaatcccagctactcaggaagctgaggcgggataaccacttgaacccaggaggtggaggttacagtgagccgagatggcaccactgcactctagcgtgggcgacagagcaaaactgcactaaaaaaaaaaaaagaaaaaaagaagaaaattcccattatcaaagtcatacaaatgttcttatgttttcttatacagttttacctttcacacttagaccattatttataagaatttactttttatatggtaggagctggggatctttctttttcctcttcataaagtgttaaaatatccccaacatcatttaatactctttcccaggttatttgttgtgccacttgtaccatttattaagttttaacattgttctctttatctgttcttgtcttagtatatttgtttcagttactgtcttttgaaatgttctaaacagggagattcacctctctttgtccttgaaaaatgttatcctatgtattatcagacctcatacttccctaaattctagggagaattattgctgagatattcttaaaattatgttatttaaataacattatttaaatgttattacacttatacaaattgtataatttggggagaattaacctctttatgatgtaatgctctcttatcaatgaacatggtatatttgcttaggtctctttaggtatttttaaaaagattctttagtgaaggtcatcctataccttaaatatttcctataaaagatagtgttaattatattattattatattattattattatagtttttcattattaaaactattttattattttattattatagtttttattattaaaaacattaaaaattacattttataattggtaatttctgctatagaataatgctactgatttttaaattttggatcttgcatccttgctaactcattataaatttttatgacttttttttttttttttgaaacacgatctctctctgtcacccaggatggagggcagtggtgcaatcttggctcactgcgacctttgcctcccagacttaaaggaacattttacctcagcctcatgcatagctgggactgcaggtatgcacctgattaatttttgtattttttgtagagacagggtttcactatgttgcccaggttggtcttgaactcccgagctcaagtgatctgcccacctcagcctcccaaaatgctgggattacaggcgtgatccatgtcctgcttttataatttttcttttggtcatgatagatgttctatgtgaataatcatattgtatacaaataatgtcaaaattgtttcttcactttctgtcttgagtattattcttatgcattggacaggactttcagtggtgcaatgatttttttcttgattttaatggaaattattataaatttttccattaaatatgataattattagagatttctttgtagattactttattcaggttttgcaaatttcatttttctccaaattttctgagagctttggttatgaatacataaaattaatatatgattcctctatctactaagattaccatgaactttttcctctcctatactctattaatattatgaataacatttttagatatttgagaaatctattttgggccaggtattccttgacatgactccttgtttttctaatatactgtgaattcagttaactagtattttagttagtattatttttggtcttatttcataagtggaaatgatatgtaatattcttttaatattctttgattttttgtatcaagattatattagttccacagcatggtactggtacaaaaacagacatatagaccaatggaataggttagagaacccagcactaaggttgcacacccacagttatgcgatctttgatgaagtttacaaaaataagcaatggggaaaggactccctgttcaataaatggtgctggtatagctggctagccacatgcagaagaagaaaactggaccctctacctttcatgatatacaaaaatcaactcaagatgaattaaagatttaaatgtaagacctcaaactataagaaccctagaagaaaatctagaaaatatcattctggacattagctttgtcaaagaatttatgactaagtcctcaaaagtgattagaaaaaaaacaacaagaaaaaatgacaagtggaatctaattaaactaaagagcttctacatagaaaataaactatcaacagagtaaacagataaccaatggaataggtgaaaatatttgaaaactttatatctattaaagatctaatatccagaatctataagaaatttaattccacaaacaaaaataccaaattttatttaaaaaatgggcaaaagacatgaacagacactttgcaaaagaagtcatacaagcaatccacaaacacgaaaaaatgcccaatgtcactaataatcggctaaatgcaaatcaaaaccacagtaagatatcatctcacatgtcagaattacattattaaaaagccaaagcacaacagatgaggctgtggagaaaagggaacacttatatgctgtttatgggaatgtaaattacttcagcccctgtgaaaagcagtttagagatttctccaagaacttaaaacagaactaccattgatccagcaatcccattactgtatttacatccaaacaaatatgcattgttacaccaagaagacccatgcacttgtatgtttattgtagcactattcacaattgcaaagacctagaatcaacctagatgcccatcaatggtggattggataaagaaaacatggtacatatacactatgaagtactatgcagccattaaaaagtgaaattatgttctttgcagcaatatgtatgcagctggagaccattatcataagcaaattaatgcaggaacagaacattaaataccacatgttctgacttctacgtgagagctaagcattgggtactcatggatatgaagatgggaactatagacactggggacaatgagggggcagaaggtaggggagcagggctgaaaaaccacttattgggtactgtattagtctatttcaaacttccctgagactgggtaatttataaagacagaggattaatttactcacagttaactgggtaatttataaagaaagagagttaattgactctcatggctggggaggcctcaggaaacttacagtcatggtggaaggggaagcaggcacatcttacatggtggcaggtcagagagagagctagcaagaacggggaaaactgccttgtaaaaccatcagatctcatgagagctcacagcagcatggggaaaactgcccccctgatccaatcacctcccacctgatccgacacatggggattataaaaactacaacttgagatgagatttgggtgggaaaacagagccaaaccatgtcagggacaatgtactttgcttattatctgagtgatgggatcattcacactgcaaacctcagagtcacacaatatactcatataacaaatctgtaaatgtaccccctgaatctaaaataaaagttgaaaaatgaagataatattagtttcaaaagttttttttattattttataaaagaatttatatacattaggagacactgttcttcaaatgtttgtggaatttacttttcaattgctgagtacaggctttttgctaggggtggtggtggcttgaatggaaagcactaattcattttcttaaattatgttactttttttaagttttctattaataattgagtactatattgatgtttcatttttttccacaaacttttccttttactgattttcaaatttgttgcatagtttttcacaatattcttcaatttaaaaatatcctttacattagctttttgtacttttttctagttttactatctctttttgatctgacctgtcagacattttcaaagaccaagcttctgcttattatttctattttttctttgttttattgattcatgatgttttgttattattatttccttctttttggtttctttgagtttactgtgttctttttcttgaatttcttacatttactattttgcctttttccagcttcatgagtttgatttaatttctcttgcatcttgggtttgttgttttgctcatttattttcaatctttgttgttttatgatgaatgtatttacagcaaaacttttttctttttttagttgtatctcatgtattttgaaatgtaatacttcattgtcaagaaacaattagattcttttctcagtacattagtggtatatatattttagaaatttctatgcatttggttgctttaaagctattcttttttaacttatctccaatgtttttgcactgtggtttgagtatatataacctttaagatgtggattctttggccacattatttgtgcatgttatatatggatttttaagaatgcttcttgtatacataagaataaactttattcaggaaatattggtccatatttttgttttttaaaaaaaaaattaagaaaagaggtttaaggctgacagttctgcacactctacaggaagcatagcattgacaactgcttccagttaggacctcaggaaacttaaaattatggcataaagcaagggaggaacagctgtctcacagggtgagagtgggcccgttttttcttttgctttacatttctttatccctctccctttatactatctccgcatacacaagctcacaagaatatgctcattggttgtgatatttaaatattttctatttttgaaaaaatttctgctaattctagcaatttgagagtgatgtgttatagttgttcacatgataattcaggtaattaggcacctcaggtctagaattagtcatttaactccaccttgatgcaaagaaacaatgaaaaatgtaatcttcctgtatgcctaagtagtcagtgaaagagtttggtacaagcagaaaatttcctctgccacagagccctttcaaagtgagggtaaatcctcccttagttttggaaagattcttggttacaatttcaccaactttttaatcctctttctttactctttattttctcttttcgttttccagttgaatagatttcaacaattctgttttcaaaaattcttgtcttctttttttctttatgtttttcttctactttatctttttctcgtgccttctgggagagttccataacccagtattccagttaagtaatgtaattttggatatatttattctgctactccattgaattatttgtttcaaaaatcttacctcaattttagaaatatctgattgtcttgctgcactgagttatttgttttgaaatcttacttccattttagaaatattatctgatcatcttgctgcatgctataaatatgttccttttactgtgtaagtatattttacttttttaaaatgttttaaatttatttactgtttctaccttttagttatttttcctcaattaaaagtatttccctttgttgtcttctagaatagttcttgtgctatttaaatgtttcttaatttttccttatatgcctatctctgtttcttggaaataaagtagacaatggataacctggcctgcaatctatttggtggatttaaatcttaatggtgagttgaggattgcatttaccactgcctttcttccctatcatggagtactttccagtctctctacccagactactgctcttgatctggggtggcaaccttccttggtatttctccatttctaggatatatgagggttcctcaggggacagctggctccccaatccttgttttgtctttctacagcaactgagcctcactactgccctcaatcctatcctgcagcctccagttagagatccaggtttcctgccctgtgttactaataaaatgggcaattacttgggaatagagatttcaggatagtagatggaaggaatttgttgcctttagcaataagatgtctgatattgtgaagtggtatggtgtagtaaaaacacctgagattaaagaagagaggaatctatgcctatttcttcttttattcatttatttatcaaacattaattcatgcatctgttcatttatttaatgcatacttactgaggacctattgtgggccaggcactgttacattgcactataaatttggtaggaagcattttttttaaaactgcttttatagtttggaggtatgggtagaggaatccatgtataatttattagggagataagtggtattaaggaaaacaaagcaagtatataatagagaatctcagaggctaggaaggcaagatttgagcagagacctgaatgaggagagtatgtgagtgggttcactcagtctctaccatttataagccacgagactgtgggcaatgtttgcatgtcgagtgaatgcgacattgtttgtaaagacacattgcatgacactgagtaagaagtcaagaagtcagagctactaataatacacattattaataaatcaaaactagtaattgaaatgctttttgtacatatcaactaactttcctgttattaaaaattatttctaatttttcggaaattccagaaagattggcagtaaacaagtaataaaccttcttattcattttgtttttatactggaaggtcattagtcacagtcttaagtatggacagtaaagttaaaaaattcaattggcaggaagtgggtgcatcttaagggccatttaagaaagtgtatgaatttatgaactttatagtgagaggatgactaacaaaagctagctaagtactttctgattctagaaaaaaaatagagaattttctctctgtctttgtttttctctctaacatgttaaattagcagaagacttcaaatagtttggacacataaacattataaccaaactctccagtgctttcaggattttgatatgcataaatatataagggagctgaaagacacccattccattttccaacacttcctttgcccttgtccacacggaccttgcacatctcattgctttgtagtcacatttgaccaaacaggttattaattatgtgtcttaatctcctatcattaacttcagaatgagtctgaataaactgactgttttgtaagtctgtcaactttaagagttgaaggttttccaccaaagaagaaactcaaaagtttggaccaacctgtctaacatcactttccagagaagtgtccaaaatatttggagaagcttcaatagtgcaataaatatataattattgaactttgctaccttaaaggaaacagtactcatttagataggtgatccaaatttttacttttttccccaaaggcaattttacctagactgttatatataaaagattaaaaacagattttattttatttttttttaatttggtggagagggatgctaatggtgaaacacccactgccatctactcaggttttccctcacttgctaagggcagcccgcaggggtccatggaatgtcatttgaaaactatgaatttaaatacctgatttctgtgactctaacttgcaggtaaagaagaaaagatggttgtggtctccactgattctttctccatagcatgagtttacaatcctagatgaatgtgttattacctactataaattttggttgttgaggaaaaagacagggatatttaagtggtataatgaaggatttcagtaacatgtgcagcttcctagccattcaacaatctctgtcagagagtagatttacttgagatggcgtaggtgagagttaaaaaataatcattccctccctgcactagatacttgcctaggcataacaattttgcaatgctgagatattttacttatgcataattagttttgtccatatgtcctatctttattcgttgattcagcatacatatatttataaaaacgtaccgtatattgagaccagtatgagggcttaaagattaaataaaaaaagagaaagagataagtttctaggcttttggcacttagagaaattacaaaatatattttacattaaaatatttataattatgaaggaaaagcatcttttggcagaggaagtcattattttcaagctggctagaattattagaaaaaagtgctttgcgggaggaggttccaagatggtcgaataggaacagctccagtctacagctcccagcgtgagcgatgcagaagatgggtgatttctgcatttccaactgaggtactgggttcgtctcactggggttcgtcggacagtgggtgcagcccatggagtgtcagccgaagcagggtggggcatcgccttacctgggaagcacaaggggtcagggaattcccctttactagccaagggaagccatgacagatggtacctggaaaattgggacactcccaccctaatactgtgcttttcctacggtcttagcaaatggaataccaggagattatatcccgtgcctggctcagagggccccatgcccttggagcctcactcactactagcacagcagtctgagatcaaactgcaaggcagcagcgaggcttggggagggacctccaccattgctgaggcttgagtaggtaaacaaagtggctgggaagcttgaactcagtggagcccactgcttctcaaggaggcttgcctgcctctgtagactccacctctgggggcagggcgtagctgaacaaagggcagagaaacttctgcagacttaaacgtccctgtctgactgcattcaagagagtagtgattctcccagcatggagtttaagatctgagagcagacagattgcctcctcaagtggatccctgactcctgagtagcctaactgggaggcacctcccagtaggggctgactgacatttcatacagccaggtgcccctctgagatgaagcttccagaggaaggatcaggcagcaacacgttctgcagcctgcactggtgatacccaggcaaacagggtctggagtggacctccagtaaactccaacagacctgcagctgagggtcctgactgttagaaggaaaactaacaaacagaaaggacatccacaccaaaaccccatctttatttcaccatcatcaaagactaaaggtagataaaaccacaaggttgaggagaaactagagcagaaaacctgaaaattctaaaaatcagagcacctcttctcctgtaaaggaacgcagctcctcggcagcaatggaacaaagctggacggagaatgactttgacaaggtgagagaagaaggcttcagacaatcggtaataacaaacttctctgagctaaaggaggatgtttgaacccatcacaaagaagctagaaaccttgaaaaaagattagacgaacggctaactagaataaacagcatagagaagaccttaaatgacctgatggagctgaaaaccatggcacaagaactacatgatgcatgcacaagcttcagtagtcgatttgatcaagtagaagaaagggtttccatgactgaagatcaaatgaatgaaatgcagcaagaagagaagtttagagaaaaaagagtaaaaagaaactaacaaagcctccaagaaatatgggactatgtgaaaagaccaaatctatgtctgattggtgtacctgaaagtgacggggagaatggaaccaagttggaaaacactctgcaggatattatccaggagaatttcccctacctagcaaggtaggccaacattcaaattcaggaaatacagagaatgccacagagatactccttgagaagagcaactccaagacacataattgtcagattcaccaaagttgaaatgaaggaaaaaatgttaagggcagccagagagaaaggttaggtcatccacaaagggaagcccatcagactaacagcggatctcttggcagaaactctacaagccagaagagagtgggcgcctatactaaacaatcttaaagaaaagaattttcaaccccaaatttcatatccagccaaactaagcttcataaatgaaggtgaaataaaatcctttacagacaagcaaatgctgagagattttgtcaccaccaggcctgccttacaagagctcctgaaggaaacactaaacatggaaaggaacaactggtaccagccactgcaaaaacatgccaacttggaaagaccatcgatactaggaagaaactgcatcaactaacgagtaaaataaccagctaacatcataatgacaggatcaaattcacacacaatattaaccttaaatgtaaatggacttaatgctccaattaaaagacacaatctgggaaactggataaacagtcaagactcttcagtgtgctgtattcaggagacccatctcacatgcagatacacacatgggctcaaaataaagggatggaggaagatctaccaagcaaatggaaaacaaaaaaaagcaggggttgcaatcctagtccctgataaaacagactttaaacgaacaaagatcaaaagagacaaagaaggccattacataatggtaaagggatcaattcaacaagaagagctaactatcctaaatctatatgcacccaatacagaagcacccagattcataaagcaagtccttagagacctaaaacaagacttagattcccacacagtactactgggagactttaacagcccactgtcaacattagatcaatgagacagaaagttaacaaggatatccaggtattgaactcagctctgcaccaagaggacctaatagacgtttacagaactctccactccaaatcaacagaatatacattcttctcagcatcacattgcacttattccaaaattgaccacatagttggaagtaaagcactcctaagcaaaagtgcttaggacagaaattataacaaactatctctcagaccacagtgcaatcaaactagaactcaggattgagaaactcactcaaaacagctcaactatatggaaactgaacaacctgctcctgaatgactactggttgtgtgacaaaatgaaggcagaaataaagatgttctttgaaaccaatgagaacaaagacacaacataccagaatctctgggacacatttaaagcagtgtgtagacggaaatttatagcactaaaggcccagaagagaaagcaggaaagacctaaaattgacaccctaacatcacaattaaaacaactagagaagcaagagcaaacacactcaaaagctagcagaaggcaagaaataactaagatgagagcagaactgaaggagatagagacacagaaaacccttcaagaaatcaatgaatccaggagctggttttttgaaaagatcaacaaaattgatagcccactagccagactaataaataagaaaagagagaagaatcaaatagatgcaagaaaaaatgataaaggggatatgaccatcaatcccaatcccatagaaatacaaactaccatcagagaatactataaacacctatacacaaataaactagaaaatctagaagaaatgggtaaattcctggacacatacaccctcccaagactaaaccaggtagaagttgtgaatccctgaatagaccaataacaggctgtgatgaggcaataattaatagcttaccaaccaaaaaagtccaggaccagatgaattcacagcctaattctatcagaggttcaaagaggagctggtaccattccttctgaaaagattccaatcaatagaaaaagagggaatcctccctaactcattttatgaggccagcatcatcctgatacccaagcctggccgagacaaaacagaaaaagagaattttagaccaatatccctgatgaacatcaatgcaaaaatcctcaataaaatactggcaaaccgaatccagcagcacatcaaaaagcttatccactatgatcaagtggacttcatccctgggatgcaagtctggttcaacatatgcaaatcaataaatgtaatccatcatataaacagaaccaaagacaaaaaccacatgattatctcaatagatgcaaaaaaggccttcaacacaattcaacagcccttcatgttaaaactctcaataaactaggtattgatgggacatatctcaaaataataagagctatttatgacaaatccacagccaatatcatactgaatgggcaaaaactgcaagcattccctttgaaaactggcacaagaaatggatgaactctctcaccactcctattcaacatagtgttggaagttcgggccagggtaatcaggcaggagaaagaaataaaggtattcaatttggaaaagaggaagtcaaattgtccctgtttgcagatgacatgacccagtcatcccattactgggtatatacccaaaggattataaatcatgctgctgtaaaacacaagcacatgtatgtttattgtggcactattcacaatagcaaagacttggaaccagcccaaatgtccatcaatggtagactggattaagaaaatgtggctcatatacaccatggaatactatgcagcgatgaaaaaggatgagttcatgtcctttgtagggacatggatgaagctggaaaccatcattctgagcaaactgttgcaaggacagaaaaccaaacactgcatgttctcactcatatgtgggaattgaatactgagaacacttggacacagggtggggaacatcacacacgggggcctgttgtggggtggggggaggggggaggggggagggatagcattaggagatatacctaatgtaaatgacgagttaatgggtgcagcacaccaacatggcacatgtatacatatgtaacaaagctgcatattgtgcacatgtaccctaaaacttaaagtataataataataataaaaaagaaatcttattaaaaaaagaaaaaagtgcgttgttataatatcatggaaataatgatattcattccgtagtgatactaagtgaaactcagccttctcagttacatacttggaaacttttgatgagtgagaagaactatttgtggcaagcaatcatgttctttgcatgactagtagcaccagccccatgataaataaatactttgtattcaatcctttatttgctggctaatgatttgcaaatcaagactattgaccatgaagatcctactaaaagggtactattccaagagcatagcttgggggtcattaaattctacaactttccccattaccaaaaaacaaaaacaaaaacaaacaaacaaaaaacaaacaaacaacaaaaaacaaacaaaaaaacagacattatgcaaaggcagtttatttcctgaatgttttccaaaaaatatgatattcttctaattcaacccttgtcagccccagtgaatgacagttcagagctgttttttctctgtcctacttagatgcaagttttcaggagagcacaacattgcccttagactagattcaaaattttgttaaggatgttgtgatttattattccggatgactcacatgaaacaatctcttaagagatgactcagtggtatttaaagaaatttcgttatgttaaccagaaacaattttgttggcaagagtacttcttctttgaactgttttataacattggctaacaatatattatctgtgaccaattgctttgtatgctctggtgctgctggtcctttaggtgatgcttacaaatgcagtgataatttattagctcaggccttactaattcttgatttgggacaatttccaaaagaaattaactgaagtttactaattcttatcactcaaagaaatggattgctgaacaaaataacagtcttagtaagagttttggaaagattttgattgagaaagaaaatatactggcacttaaaacatctggttgaaaattattattatcaatatctttacctgtaccttttaaattattggctgggtgatcttaatttccttttctgtaaaacagtgataatgattataccaatttcttggtatttcaacaccttcattcatgaaattgtggtactgatggagcctgcatcatataattattatgtgtgataatgggttaatatacataaagcgctttagtacctagaatatacaattcttccaaaagtttagctgttttaaaaagttattattagcaaggtgctcattactctttgttagtaatgtaagacattttttctgggccttgttcaaccatcagagaaaaattatagttataccactattaattataatggtgtgaatcaaatttatacaatttacagtgatataaataaatattctaaaataggcatttcactaatatagattttcttggattaatgaaaaattcgtccctctgttactgttcttatgggaaaaatctgaattgcacttactaattgtcccacaatttttgtgttttataaccccaattgtatgctggaaagagcatcaaaatgaaaactggaaaattacctattaggtataatgttaattattggggtgatgggtacactgaaggccaaaacttcaccatactcaatacatgcatggaagaaatctgcacttgtaccccgtaaatatctgtagaaaaagttggaataactgttttgttcctgataattttttctagcttcttaacccctttttcctcagagcccttatccttaactttggtaataataactatctgaaatattttatgaggataatgtaagattaactgttgtgcttctgattaacttttagacaaaagttttggcttaaccagcctaccttcctccttctgctgtctgcatcgggtgttgtttttttttttttgtttttttttttgttctttttttggtggagaggggcggtggtggttaacacctatacttggagatactgttgtaacgccaattgtcaaaaaaagtacacttttaatttttaataagtttcaagaaatgtatgcctggaattataaacttgaactgaggcaccaagacaaaaaaccgatagatgtttttatatctccaggggggcatctgatccagatcaccagaactgcacttgttcctttcctttttgtgtctagttcagtgacttccattgtttctgtttgctatgtttgctataccatattattccaaaaaactcctgtttttttgttttgtttttgtttttgtttttgttttggtggttgggggtgggtcatttacgcaaagttggtttctattgctttcaattaaaatccctaactgaaatagtgtccaaagatagtattttggtgagaaagttgtggttccaggaattgattgaatttagccttgtaaaagtcactgagcttgtcagaacttggcttccactgaagttagaagtgatttgggcttcttggttttggaagttcattctagctctaatactactgaaaatgtttatggtataaaatagaatattaaatattatctgaataaactaaaagtatttatatacatgagcaccttactaggtccatatcaacaattacagcactttcttgtgctatgttgttagatcagcagagcacagaggaaatgcatttgaagcaatggcttgaaacagtaagaacatagttacatcagattacaggaacaatatggctgacttttcccttttgaggggaaaaaagcctgagggaacattattgacagtagcaaataaaactttcctgcttctgagattttattttctcttttattctcctacctacactgtaaaagagtagttaagacaactaccaattagttgtcagttcagagcaagcacaaagatggaaaaccaaccctaagatgcccatagtactggcttcaaaaccttctaatctcatcaaattgttcataaaagtattattaacctagctggttatcaatcttggtcttcagagctattgattttttttttttatgagagaagaactatttcttttctagggaatgagttgttacttgaattttcaaatgagactcatttttatttactttggcaggcacttccagcgttgtttcagaagtaagttatttcagggagggagatgaaatggggagatacagtcatgcatatggccttttactaagattcactttaaaaatgaattttataggttcttaaaagggaagtatcttaaaattaaggatagtatttatttgttgaccaaggttgctattaatagtacatctagtaatcaatgatgtcttagcacccaggaaacacaggacacaaatatatgcatagatagataaatatataactatacagctagacaatatatgtaatccactgctatacacacagcaaactactaggttagtacgtttttggaaatcaaaaattaaaactatgaagtagaacaaaacttccaaaaaatagaacgaatggaagttctacatcaatgaatcctgatgagtttatttgaggcaccatcttagaaggaacgtcatagtttgcagaacttataacttgaataatatcaagggctcactagataatcaatcacctaagttgatgttgatgttttagtaacattggtgtttagtcatattacctctagcttgaaaatgaaggtatgatcatctttccttttggctaaaggatgggatatgctgaatagttaatgaaacattattcatcttatgctggagttagtgaaccagtacatcttatactttatttatgtattgaaaccaaaataagaagaggacatcattaattttaaggcagtctttttttataggttagttctatagcaaaattatggaggacaaaattttaacatggaattaatattttaaaataagtatattcatgctaattttgaatatttgttgaaaaaaatttgtattttgagaaaatatttttttcaaagcttttggtgaacatagcttttggaatgcttctctatgtagatattcttatattctggtgtgttctgtcccacttaacctgacgctacacaaccctgagttgaattagaaaggaaaattatttctgaatctgcacactgccctggaagctatcagctagatttttccacaaatgactcactaagaagcatagaaaatgatggtgcgcatgaaaaagaacaattgttccatttttagaagaatgaccaaaaggttcatctaagtggcttaattttgaaggcagaagaattaaatgtctgcttgtgatcttggctctctttttaccctcaacaaacccttggaatgctccctgatgcctttcttaatgcaggtcttggatcatcagatgagagagctataatggtgactaaatctttcatatcctcaaattattaatcactgacctgccatttcttataaacagatattataaattacaaaatattatacattacaaaaaggtaaaaataaaaagatacaaagattttagtcagaagttcttttcctgtacttgacatcttatttaacacaaagttgcacatatggacaaaaagagcttaaatcttggttttggaaatgaaataaccatgtaaacatgaaactcatcaagtcaacattgtctaagaaatgatctagggccaataataagaaaattcagttttaatttataaactcaaaatttgttttagaacttttttttttttttttttttgaggcagattcttgctctgtcccccaggctggagtgcagtggcatgatctccactcactgcaacttccatctcccaggttcaagcgattcttctgcctcagcctcctgagtagctgggattacaggcacatgccaccaggctcagctaatttttgtatttttagtagagatggggtttcaccgtgttggtcacactggtctcgaactcctgacctcaggtgatctgcccaccttggcctcccaaagtgctgcaattacaggcgtgagccactgcacccagcccagaaccatttcttatggttctaaaaccattataatgctcattatgaatgtatcaaggtgctgccacatcagaaatcatccacaagaatgttaaataatgttcggtccaactttaacaagaaaagtaaggaagtgaatatatttcactaagatttggtagtcagggttaaaacaaaaaggatattctgattaactgctagttaactagattccttggtttataagcatttttgtttttatattgcaatttaagaatttacttaaatgttagttggtttaacatttgcttaaatgttagtgtaaaagtcagtgctgaagtacaacaatagtagaaattcccgtaagacaacttcttaaaatttcagttctgtgtcttagttatcaagtgattctgggcaagcaatatcctatcttcaggtctctattttcttgtctgtgaaatgaaggattagaagttacttccaaattctaaaattataagactctggataaaagtgctccacttttataatcttttttcttatgttactgaatgtcactgctttatagagactgtatccttttcagaacaggaatgagggaggcctcagtttttagcagctagagcaatgctagtgtgccaaaagtgtggagtaaattttcttgtcattagttttaaatagcaaggctctagataagattttgtattttatatacttcaaacacattaagcttttacttcctgttaccaaaaatatttcatactttataaataaaatattattaaatacactgaaaattttcacggttcatttagccaatgaaagaaatcagttttgtatgtacaagaatagcttttctctgactatcttgcttgtgaaattgaaccttcttactttcatacattatttgtgaatgaaatcaatagaaagcctaaaatccaaggggcggaatactttaccaaaggaaatttcaatacttgtcaaacataaatgtaagacaaaaacactactttaggcttatgtaaaattcaatgaagccaaatgagaaagactgaaagggagaaatgaggttaaggaaagaaaaacccaagtgtgttagctgtgagcagtctattcaatagatgagactggcactggtgcaggctatctcttctcactgccctctctccttgttggtggagcttgactgcagtatgcagctagtgaatagctcaaccctttgataacaaaacttgagaaaggcttctgggggcttttgggaaatatttatctcctgaaaagagagaaggaaaggaggagaaagaagagagtgaaggggagagggggagagaaacagatacacaattctcttaagttatgttttatctacgtgagatttctgaaattgtggcaatcatcttgcagcgtaagtagacaaaacaaagaactaagacggtaatccagtggaatggcagagcaggaagataagaagcctggatccctggatatttgaagtagtccctgaatgacctgcctttggctttgtgttgtgggagataattttagttattttttaagctattctagttgactattgtgctgcttgcggctaaaaggggtttaattcttctatctctagctacttgctcactctgggtatcgtttgactttttcccatggagcacatccaatatttactcctctaagattgttttaggttgggagaactgggtgacttgttggaggtggaggtggccttttagttccaagttttactccctgttgtagcctgaaatagtggttttggccactctgaaagttcatatacctgtactcagaacatttaattggatatactataaaataaacaaaaactaaagctcaatgattacaattgtagcaatagtgttattatctgtaatattttgtagcggagaaaatgagagatgacattctctgtgattagtaaccagtgccttaaagaaagtgagtaaaatgatttactgaagacctaccattaattcacagcatattatcatgaatgagtcatttaagttgttgtttccacattgcactactttgcccttgtcggtgctgattttgtttgttgtcacattagtcacttgttcagttatttttggttctcttaaattttctaataatccctaatagagtttagtcagctaaatacttttgttggataatatatgcatgaacacatctgagagttggacagaagaattttaatttttgctaattagtgtaaaactttacttcatttttttctcagatcagttaatatttatttttgcatctcagctgattttctctccagcctttcaaatctccattttatcaactataataaaaatatctgataattctagtttttgccacagatactttattcactcatttaatcagaaatatatttcaagcatctaatttgggctaatcatatcagtactgggacatacaatggtggagaaatgaaatttattttctgtcctttcagaacatatagtctagtgtcatttagtttatatcagggttttagcatgattttatataactgatgacaaatgtacttttttttagaaataattgtctagtccctatggccatagtctctcctcttaagtcagttgtagaataggcatgagtaaagcccaatttcaaattggtataaaggaatgcctccattatggagaagaaagcatgctgtattcatctgttctcatgctgctaataagtacctgagactgggtaatttataaagaaaaagaagtttaatggttggagaggcctcacaatcatggcagaagatgaaggaagagcaaagggacatcttacatggcagcaggcaaagagaagaatgagaaccaagtcaaaggggtttccccttatgaaatcatcagatctcatgaaacttgttcactaccatgttaacagtatgggggaaaccacccccatgattcaattatctcccactggatccctcatacaacacatggaaattatgagaggtaaaaatcaagatgagatttgggtggggacacagccaacccatatcacatacaaataactcacttttacagtttacaacaaaacaaaacaacaacaagaaaatattttctgtccagaggaggcataagtatgcattttaaggtatcaggaaaaaaggagagtgttaagctaagcagatgaatatgcgtttatctttccatttgacctttcagcagtatatggcacagttgaatacttcctctttctttataactttccttggcttcccctacacaaaattcttgaattttatccaatctctattgctattatttcttagttattttgaagatcttctttctttgatggattttttatttgtttctattttacaccctttacaaacaaaaactgggcaatgttgtcccttcccatggcttcaattgctatctaaaagttaatgtttcccaagcttttacttagagtgtgttgtctctcctgaacattagcctagacccacaaattccactgattatttgatatcttaacttggatatttgtctggtcactgaaaagtcaacatgtttagaatattttctctaatctcttcttcctcttatgcttttatcaaaaaccatcacctttccttctttgaaactggcatccaaaatgtcaccaactccctttagtactatctctaacattactcagtttcaaccactttcctccatctccgtcttcagtatgccaagtcataccctgaatgtcatcactcacctgaatgaccagactagtctcctagctggctagtttccctaatgctgctcatgattctctacaatttattctcaacctggaaagctgagtgaacttactgaaagacaaacctaatttactctcttcatgattaaaaccttctctcataagttaaaattcatcttcttaacatgacttaaaatctggcccttctagtttgcatctttctctgccatccgcaatagcaattgtctgaatgtattatattacagtaccttgcatctcaaaatgtgtgtgtgtgttttcttgaacatttgttttctttttacctagatagatgctgtatgtgcttcaaatctgtttctatgttaaagtttcagaaattcttcatggattatcccgccaccctcaccttcatgaagttgggtttgtgtgtccttgcaatgattctccatagcagtctctactcttagcacagtatattatagtttctgtatttgtctttgtaccgtaccaaacagtattatctaagagagcaaggaataggcctgaatcgttgaatattttacccccggcacaatactggcacatgatcaatacttacccgttatttgtttaatgaaacaaaattaaatgaaattaattattaattcaaatacagaatgattaacagaatcatgctaacattgagatgtctttccatttttgtaatgttgaataacatttcttttggcatagagagttactaaaaagtgtcaaactcaattgttgaattttaaaatctaaaactcttgaatcacatttgtgtttttttttctttaacctatctctttctctcatgtttattaagtctgtgatttttccaagtatgttagttggaaggtataaaataatctcttatgtctgtttttatccctagcaaatttttatactcagtgatccctaagggagagttcctagtgtatagaaattatgttaacctggactgccattttgttcttttaattccagatgaagtgtggctctcaaatttcccacagaaagagaagagaaagaaaatatgagagatgaaggaaatggactagaagcagtagtaagagagtttagcgacacaatttagatgatgatgtgctatgacattcttccttctcctgtgtttcttgaccctctgtaatccataaacctatacccatatcagtagtgactctgttcatgctgaaatttagacttcccacatggcctagggcagtagcttgcaaagtggttcacagagtgaccgtggcaggtatgtgtaatttttaagagtttcctgaagagtcctgatttgtagccacttttgggcaccattgaccatacagtctcttctctgcatactgcagactaaatttctgagccccagttgagaaatgtctgaaattttttgcacaggtcacttagtctgtacagttttggaattataagtttatataactctcaatctatagaaaagagaattctatatctaaaaatctatatagaaaattcaactaaatatcacaaacttaaattcaactaaatatcacaaactttataagggatgttctataggatttgcgatctttttattggtgtggcagtatatatatatctacctgtcttattttttctagtatatacaaactactttaatatgaggtgtactatcttgttctttttgtatcccaatatatagcagaattcatggcacacagtagatacccaaccaaaatgacttttaaataaaaggattaataatttttctattcatgttcttatcctgcttcatacaaggctctttacctatattatgccatttgggccttcaagctcatctgaaaaatatatactaagtcatcactgctagtacagggctttccacattaatcactcactcttatgaaattttgcaatgttctctttaccaaagttatttaagtgtatgtccatatatcccataaattttaaaatctcaagggtagtaatgtgtctttgaacccccaaagcacaacccctctttaataggacagattctactgaattgattcatcattaaaaaaaagaagccaaagtgggtttggtgccaatccataaaatatgactgtaattgattgtctcttgtagacctgcctttagaatagttctttgtacccattatatgtccttctctaacattcattattggacaacattagtccttggatggatcactgaatgctataatcataagtaggtaatgcattttgcactcagttgttcattatgctttgataatggaaaaagagtttctttaaagtcggaacgaattatcacaagtggctctttttttcccaagtgccaccaacactcaattaccctggaactgattctgtagttttcaggttatacaggccattacctcttcccctcttcttgatgtctacctttgcaccatttcactgctcattagtgtctggaggaaaaaaaaaaacacttgagaaggcaaggaaggtgaaatacaggttggtcattttgtacttgttagtagccgtgataaaagggttttgtgggaaatgtgattagtgaaaagtagtgggatacagtctggactgtgctctctatatgtgggtcatatttcaatcttatatcatcaattagcttagaatatttagaatttgcttatagtaaaagttgtttaaagacacaaaatctctctcctatttttttcataaaataatttaatgacacactatagatgtgtgttctttaatatgtgtgacactaagtttgtgctatttagtacatttaaaaatactatatttgtgataggtaggaccatcctagaacccatactttctattgcactttggaatatttggttagagaatggtgaactgaacagagctgccattcttgacatttttatccaaagaagctatcttttgctccaaggaactatgtttcatcttctgaaagtcccaattataacttagttttcatgtcttcctgcaattagcatggataaaatacgttgtgaattttgattttggacacaaataaagaatgtgcttaaataataattaaatccatgtgtcttcattcattttgtcttctgactggagagagggaattcctgtgtctctttcttatagtctgatgtaaatgatcattgaggtgacctttatatttagcaaaaatgggagttgaacatgaatggtaggtgtagtttatgattcatgagataatttaagaagaaatagtgaataaagcagtgactacctttttctctgtaaatcatggaaacaaaaacatggggcaaatttattttcttcatgtttggattctgaattatgaaatcactgctgtgttgtaatatagatttttctcttagtcatcattgtcctttaaagttcattttttataattgaatattctaaaatgttgcaccacatccttattgaaaatgttaggaaaatgaacagaaaatattccaaaaatccatgcaactcatttcttgagaagagtcactaggatttttttttttttttttttttgagacggagttttgctctgtagcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagcagagatggggtttcaccgtgttagccaggatggtctcgatctcctgacctcgtgatccgcccatctcggcctcccaaagtgctgggattacaggcgtgagccaccgcgcccggcgagtcactaggattttacaaggtttatacttctctttggaaatgctacttatatttctgtttccccagatacatggaaatgtaagtggatggtctcaaattattttttaacaatgttttgatatgttctgcttaaacagtagctttgctcctcttatcttttcctttctaatatattaaaataagctcctcaaatatttaagttctctttttatttttctattttatctgttataatttgctctttgcagagcttgtctgctttaaaaatgtatgcattgctcttttatatatatatatttataaacactatatatttacacacacacacacacatatatatatttatacacacacatttatgtatttcaggtagtttgagataatctgggtttatctcaagcctattagttgtaaagtaatgaacataagcgctagaacttatacagatgagcaagtcataaaaccaagtgtcaaacttaaatagctaggaaacaaagctcttcattttcttttcatgaggactaagctggtaatcagtgatctcctctaactctttttcctttacatgactggaacagtgatattgcacatcttaggttttcctctctcctttttcatattctatccctgttcaacacatttttcttcaccaccgagttcatatggaattcttcctcttaacatccacagagcaatttcactttcacttgatatactgtttgtgtcacctgaaccttaacttattcggtcttatatttcccccttaaatgttgaggacagcattccttaaagtgttctatagaatagttgttctataatacagtctcgtagcaaacagtttcaaggctaaatttgacaagtgctgtatactttatacgtttctttgacatttataacaaatattagcataggatctgaaacttcctgcaacaaatcagtctagcttaactttataacaatcttcattttatgttttttttaacctttctttttctaaagcatctgataatgtcttatgtagactttggtatatgctaattttgagtgtggtaaagaaacttttcttaattatcagattgattatttcacatatctatgttaaaagttagtgtctttcacattattttaatataaaaaatacttttcttcttacaacttgatttttaccagactcttttaccaaatagttataaacatagcaactccacttttctcccaatgaataggaagggttgtcaactcctctggcagatcacacctaaactggtagttctttttaattaaattttaaatttttaatttctgttggtacatagtaggtgtgtatatttatgaggtatatgagatgttttgatacaggcacgctatgtgaaataaccacttcatggataatggggtatccatctcttcaagtatttatcttttgagttacaaacaattcatttattcttttggttattttaaaatgttcagttattattgatgaaactcactctgttgtgctatcaagtagtaagtcttatttattttttctaactttaaaaaaaaaaaactattaaccatacccaccttatctccagccctcgttacccttcttagcctcaggtaaccatgcttctactctctgtctccatgaatccaattgttttgatttttagatcctacaaataaatgagaatgtgcaatgtttgtctttccgtgactgacttattttcacttaacataatgacctccagttctatccatgttatagcaaatgaaggatttcgttgtttttatggctgaataatattccactgcataaatgtaccacaatttctttatctattcatctgttttggacattttggttgcttccaaatcttagctgttatgaacattgctgcaataaacataagagtgctgatatctctttgatgtactgatttcctttctttagggtatttacccagcagtgggattgctagatcatatggcaaatctatttttagttttttgaggaacctccaaactggtctccataatggttgtactaattgacattcgtaccaacactgcatatggtaaactggtagttcttattaagaattaggtaactattttgagagcaataaatattcattaaaaattgccatttttaacaagagcataattcaattattaaaataaaacaaacaaaatgccaagcagaagttattagatgcagtaaggagaatggtctggcgtgaaaattaagggaaaaaaatgaagaaggtcaaaaatgaggctattttaataatccaggagaaagtttcaggttgtgtggaataaggtgtaggtgacataaattgaaataagtgaatagattttagagatgtataggaggtaaaagaaacagggtgaagtaattaaatatacagtaatagtaagaaagataaaggtggggtgctactatatttctagcttgaaaaagcattgattcgaattagagaagtactgggattggagggggtatggcatgcagaaaaccgtgctttaatttttgaccaagttgaatcagagctgactttaagaattcagggtgaagttattaaataggcaatcagatatattgaccatttttttctcaatagagaaaaaaatgaaaacaagtgaattcattagaatacaaatggcagtttaagtcaggaccatgtgtgagattatttaatatttaaaaataaacacataaataattttatttattttttaacttcattttcttttcacatgccatgagattattgagctacactaacaaacaccaaatttcttgctgttagtaactaaccttctcctatgaagatttgtattcagctaagtggtaattatctcctaaaatacaccaaaatgtttctaacctggtgattttaatgtttcattttaatacttgttatcagtgcattcagcagagatgattgccagttcctggaaataagttttcatacactcaaacacctttgctctgttttaaatctaatttctctatgcgtggactatctatgatgccctcttgcctactcaaggacatcattacggatctattctctctttttttgcctacattatcattttttttcctctctacttgatcagcatatatgtggttttgcactggattgatttggctaagctgtaaataagtttgcaggttagtgttgatcaagagaaatttgcttgagatttggaaggttgaagtgatgcataagatgttattacctgaaggtcagtgggaataaatgtggtgaaagacatgtgcatagataccagtaggtttcagatttcctcttctcttccttgttatgtgaaacagatgcagaggttctggtaggtttcagcttgactacatcttctcttctaagcacttctttctggctaccagccctgttgaccaccagtagcctcaggcccaaaaccatgtgcaaaagctgtagatttcataatcttctccattagctctctcttgtggtcccactcaaacggctggatgtgcctggctttccagatttcctctcaaattctcagtgtccaaccactccagtattttggaaggctggttagttatttagttactttcattttaccctccaactccccttttggatgcctccttcctcagattcttcataaatatgtaaagttttattcctagaatcatttattatataatattcttagtagttttctttccctgagtgaatcgcgattgatgaagtatataattatgttgctctagtattaatggggagaaatgctgaattcctctgccagttaccaccagctttcattacttttccttgggtcaaaattccttaaaattgtttttatacttgccttctccaaatctcttattctctcctaacccattctgattcatgtttcatttctatcgtatcacataaatagttgcatcaaggtcaattatgatatccacatttctaaatcaaatggtcaattttatgccttctgttacttgaactatcagcaacatttgacaaagttgattacgccatcctccttggcatactttattcacttgtcttctagaatactgtacttttttggtttttctcttatcttgactattcctcagccttttttcccagtttcttttgttctccacactctcttaatagttgagtgcctcagggatcaatccttggtcctcttatcttctctgtgaaggttcactcctttcgtgatctaattctgtttccttcctgtctacttacagatgatgccccaaattttatatccaacccagaatatctcaaaatatagactacatactcagcatctccacttggatatctaacaatcaactcaaaatcagcatatcccaaacccctatttggactatttttccaaactcagatctatctgcagccttctccattttgtttgatggaagctctatcccctctgtcattatattcaaaaagtctagattagtcatcataactattccctttctctcacatctgaaatggctagaaaattgtgttgactcaactttaaaaatatgtctagaattcaaacacacaccctaccactgctcttggtggagtcaccatcttttcacctgaggttactttagtaggctcttgtcagaattctgacaattcttacaaatttgtctatctgcagtttattataagcacaacagccatattcacccttaaaaacataagatacatctctcattcccttactaaaaactcaactgatctccattttttgttaaaataaagctaaaagtcttacaatggcccacaagatcctacatatagtgaggcttcctcacttatctctttgcgctcatctcctacttctgtgctacaacgtcatttccttctttactgttcctcaatcatgctaccttgtggcttttgagtcaattgatattcatttctcttaaaatatctatttgtttaacttccccacctcttttacacatttacagaaatctgattttcttaataacaccttttctggcaaacctaatgctacctaccctgtcccaatgctgacacttgaatgtccctttcaactagtcaattttttttctttttatatagcgtttatcactgctaatacaagatttaatttagttactcattatactttctaattttctgcctatctcagctaaatattaaattctatttggatagattcttcatctatcttggtcattgatatataccaagtgcctacgatggtgtctggctccaaagaggtactcaacaaaggtatgccaccagatttttgttaaagccactcttaaatacagcagcctttggatattagctctaatactattttttcttggtatgtaagagatataatgcaatctctattttctgtatcttttgcttcttgatttgtgaagttgtcttctatgtaatttaggaatgctttgacattgcttgtttgtcactattatcctcaccctgtcaaaatacaggagagttggaaatctcctttgaatatgagacagaacaatttagaatatagaaaatgttgacttacaggttttcattgttactcacctttcatactgatgttcctttcctatggctggccgatagccatcatagttttttcggcatttttttattccttacattattagctgaagtgctttaccataccactattcattgtcaaattgtatctctctgatattgtaaatacttttgatatataatacactctcctgccattctctttgttaacactccaataatggaatgaaccctcgaggttctggttatgcccgctaggttatgacctcctctccatgtaagcacttgtaatgttctcaatcacatgccatatgccatacatttatgctttgccacctcagtaaatgaataacatttgtctctcaatgcagagaaaaaattataattctgcattattttaaatctagaaaatatatagctatatatttgagtcaaatatctatgacctattttacctagagcaaaaccacttagtgtattttaatatttctaaacttttggagagtaagagaagaacattgtaaaacaggaaattttagtaattaaaactaaaatgacaaattgggaatattttaattatttcataaatatgaattatatggcaaatattttctaagtggtaatgattattaaaatgaaggtgaacattagaattgattaatctctggaggggaagtagaaaaaaactctgatagcaccatacacagactctaatcattctatgttggacgattcttatagttctttttttttttttttagacagtctcgctctgtcaccaggctgaagtgcagtggtgcaatctctgctcactgcaacctccgcctcccggtttcaagtgattctcctgcctcagcctcctgagtagctgggattacaggtgcctgccacctcacccagccaatgtttttgtatttttagtagagatggggtttcaccatgttggctagtctggtcttgaacccctgacctcagatgatccacctgcctcggcctcccaaactgctggaattacaagagttagccactgcccccatccatagttcacatttttaatgagccatttcttttccaaccttagcaatggctgctgcctcttacattgcatagttcagccaggcccagttgctctcacttcctccagtagacctggtggtttcatgccagacgttgttcttactattccaaataacctttctgactttacctgcaattgcccccattgtgtctgtttgttagcacttatttatcttttaaatttaagtgttgcctttttttttcctgacttctacctgggaaaagtgttaattctttcctttggaaactgcacataattaactgtataatagtgagtgcatacagcttatttctttttcccaactagactaaatatcttgaaggaagttgcaatatctttgtcgttataatatgtccagaacatagcacatgcaagatatggtgtagttatttagttaaatcttcaggtgactgatacaatggctgaatgagaaaacattgaaataataaagaaaataaagaatacgtttaacaattctgggttgcatagagcagactggatgtgattgatacaattagcaatggctttccattaaagtatacaaagatgcaaaaatggtcacagtattttaaagtaaattcaaataactatctagaaagaaaatggggaaactgtgttgattcttcactccggtctgaggtctaaataaaaaaccccaagatgcaaagaaaccataacctgataaactaagcaagctttcaattcactggaaactatctttggtttgaaccaagatttctggtccattattagcagcagcttatttctgtctgtattcatttaaagactaacctcccagtacaaaaaagataaagaagggaatgagtgagagcctgtatacttggatgcttttttaaaagcattagaagaaaaaagcttcagaaacagggatagaacacaaggtgttgggattacatatgccaggatatgtcttgaatgttttacgtggctaggagatagagcaactgcattttattctctagcttcattacataaactgccattctgagccaaaaaaaaaaaaatccacttatagttttgtggaccaagagttgttgaatgtttgttaggtctcataaactgcactagatgctatacagagcaacttgacattcagattagattataagatccagaaactgtcagaatgtctcctatgtgaagagtaagtgaacaaatgacacttcactcacacttttgtcctcggaccctaagctgatacagattttgcccactcaaagagatggaaataagacctttaaaaggagggggatatgctaacaagagagaaaaacaacatttccctgaagacaaaaaaaaaaccccaaatatctgaaaaatgactttttatgagaagtaggtggagacttgaggagacatctgcatgggggaagatctacaacatggagtagacataaatcatggaggagaattaacttgagcatcagagaataaatcttccctctcgttttaaattcaccattgaatgaacaaaagaatataaaaatagaaggaaaattcagcatttttaaattttattttattattattatactttaagttttagggtacatgtgcacaatgtgcaggtttgttacatatgtatacgtgtgccatgctggtgtgctgtgctggtaaaattcagcatttttaatggaaaacatgggaggatgccatctatatgccagaaaccccaaggatggggctatattaaatgaaggcaatggggagatccttacaagccttttctagggaaagtaatatgggatgataagaactaagcaaagatggtcatggcacaaacgaattaatattttcctaatcagttatattaagactgtagttgaaaacaggttgttaaacatgagagaaatatataaattctttatgactatagaatagcagtattcagaataggttacttagagaaaacaagagcaggcatgtctgtttcaagcagagtgattacagggtatttccagacatggaagcaataggagtaggagacagagacccaggaagttggacagacaccccatgtggaaaatggagaatagagcagagtgaaataattttaaaagctagctcctatcacagaaaatttacccatcagaaaggacaatatgactatgatggctctaaatgaggcaagcagttttctcacaaaaggaataaacttgcattaagccagttctcagctagaaatctgaaaagagctttaaatagcttctaagaaaacactaagaggatcaaagtaaaattcatctttgtaactgctagtctagaatgtgccttctcttcaattatgtgtaaacaaaacaacactgaacagaatcttttatatgaaagataaatgtaacacatgaggtaaggaaagagtagttttgaggaaaaaaaattacgagagtgaaatattttaaaagaaatttcatgttgtgttcttaaaataattttaaaaatatggactctgaaataactcaggttcagatcaagaaaaagaaaaaatacactagtagatagctttttacaggaaagaataaaaacaaaattgtaatagcagaattaaagactgaaacagaaacaataatggttaagaaaatcagacaagttatatgtggatggaaaaagcttaggaggctttcatagaatgtataaggaaagaaataaagagatgaaataaacaaaggagaggctgaggaagaagcagagaataaagatctaaaatatgaataattatttcattctgaagaaaaagccaaagtaaaaagaacagaaacaatataggaagaaatactaaaagaaaaatttccagagattaaaacaaacaaaaaacaaacttagagaggagaaggatggtttctacaggctgggaagggtaatgggggagggagttatggggaagtgggaatggttaatgtgtaaaaaaaacaatagaagtaatgaataagacctactattcactagcacaacaaggtgactattgtcaaaaataattttttttttgtttttttttttgagaggaagtcttgctctgtcgcccaggctggagtgaagtggtgtggtcttggctcactgcaacctccgcctcccgggatcaagcaattgtcctgccaaagcctcccgagtagctgggactacaggcacgtgccaccatggccggctaattttttgtatttttagtagagatggggtttcactatattagccaggatggtcttgatctcctgacctcatgatccacccacctcggcctcccaaagtgctgggattacaggtgtgagccacggtgcctggctgtcaaaaataatttcattgtccatttaaaaagaaataaagagaataattagatttttattaaacacaaatgtttaaagtgatgattaccccacttaccctgatgtgattattatgcattgcatgcctgtatcaaaatatctcatctaacccataaatatatttacctactatgtactcacaaaaaataaagtaaaataaaatgataaacaaacaaaaaaacccagatcatgaatttgaaagcagttcaccatatggtagtaaatattgattttttttaaaaggctacctatgccttgaactattttactaatttgtttttacttctgggttttaaaaattgtataatatttatgcagaaaaaaaacaaggaagaaaaatcggagttgtaagtttggtctaatacctatttggaaatatgagaggtatcaagtaatatataaatacttgaaagaataatgctgtgaacaacaacacaatatataattaaagtgtccttatatgtgcaagcatataaagacatttttctttttggaggtaggggagagtgtaacctggaattgtaaaccatttactatcagtaccacaacaagtagcagaaagcaaggtagacaaagttcaaatatactccctttgtatttctgttctattattttattctatctatctatctatctatctatctatctatctatctaatctatctatctttagagacagggccttgctttgttacctgggctggagtgcggtggcaccatcatagcttactgcagcctggaactcctggactcaagagatcctcccatctcagtgttccgagtagctggggctacaggtgcatgccactacatagggctattttgaaattttttgtagagatagattcttaccatgttccccagacaagactagaacacctggcttgaaggaatccttctcctttggcctcccaaagtgctaggattataggcatgagccaccatgcctagcctggttatattcctttaaatccaacattggtggtactattgtttatgacaattggaaaatttatacagtcaagtattttaaaatttaatagtaaatacctggagaattaaaaataagataattacattgtaaattactacagtaaaatgaaagggcatcctccacacatgctgataactttttgccaccaacacccttgtctctcatgtttgccccccttgctccatggttttctctggagccatgggaactttctgagtctacacgtaaggtatcctgagcatgccaggaatgtaacactctcagaaacaatccttattcaatgagaaatagaaatcagtggataaaatcctcaacttccttgtccctcagtgaaacaattctgagatacagtcattatcttcctcagggaattttaattaggattgagcctcagatgctcacacaggtactttctgctttcacctgactgttcccggccccactttgttccttctttccttgtactttctgtgatcacctcccaaataaacaactcaagggtaccttgggggaatctaaagtaaaacatagaaaatagaatatagaaatcaagaaagcattttaaaaaggaaaataagataaaattaaatttattttgacaataatttaaattctctcactggaaagatgttcagattggatcaaatttcacactgactggaagagacagtactaaaaccaactgacaaagatagcttcaaaataaaagagtgggcaaaattttgattaaatacaaggcaaaataaggatttgttaatataaatgataaagcaggcaaaacagacctttttatataaatattagttaaatctaaaagttttgtatcagacatggattcatgtctgatagctttcaatagcttattactactttcaatagcttactgctatcattaaaaggaacaataaattaaacattcacgaacggaaggaataattttacagattgaaaaggcataaactaccaagttatatatttgtagataacacttactggtatattgacatttgagtatgttagaaatgcagtaacatcctagatccttcaatctattaaactttaacaatattaaatggtaaaagaaattatactagtccattcaggctgctataacaaaataccataagtgggtgacttataacttacagaaatttatatttcatagttctggagtctgggaagtccaaattgaggcagatttggtgtcttgtgagggcttactttctggttcataaatcacacctagctgtgtcctcacataatggaaggggtgaggaagctctttgggcctcttctataaggacactgaccctatttatgatgcctctaatctcatgacctaatcatctcctaataccctcaccttgaggacaagcatttcaacatatgaatttggggggacacaaatcaggaacaagctatggattcccatcattatacttttcattaaatgtcactctgaaaatttttggttcatatggaaataaactattaggaaggtttgcactgcactgtttctcaaggtagataataaaattgcataatacaaaacaaaagacagcaaactgagaagctattagaacacaagtaaccgaagtgaaaaaaatttgcaaatattctaaaaataaaataaaaaataaaattccattcataatagcatagagaccttaaaatatttgttactgatatgaggaaatttacaaaaaaattattattgagtgacatctaataagacatagaaaaattatatcatactttggattaaaaaaaactgagtcttgaaaaatttcaaaaatccccaaatgaattacggggttaacatatttaaataaaatttattttggaaattgaataaaggctttctagattagtttatctgggaggaccataaagtgtggcagaactaagaatttcagaaaaatgtttaataatacattctactaaaaatataaagtgtgtcatattaattaaaagcagcatagtacaattttttaaaatcagactattttgtatatgaatttaagtgtcatcaatatgcagttagatcaataccttaaaatacaaactaagtataactaagatgaagaaaagaagtattttaaaaaaaagtaaaataagggactcaggaaggataggctaaggtcagcaaatgtaacgttgttgggtgatatgtgaagctgtttctgcccctttcccaacaatgcttggtggcttgtaaggctgaggttaagaacatctgaaagcaggttattagggaaaactctgagcactgaactgaatatccgtttgctgtccatcagcatgaagccttgtgtgttgtattgatgacacgaaatggaaagcatctcaagctatgaggactgaaaaagaagccaggaaccatgaagttcttcaggttggagcacattgtttcttctcattagggcaaattatgaaaagagtaggaattaattttccagcattgtgtataaaaagaatttggtttagaataaaatatcataaaataaatacacagcaaaaattttaacctttcctagaactaaaagatttgcatttctggaattataagagccagccaaatgcctagcaaaatgaagaaaaatgttcactcttgtgaattcttagaataccaacaataaagagaagatcctaaagaattctggagaaaagtcaatcaagcaatcagacaaacaaaattggattttatgtaaaggatgaaggtcacaatggcattgaatttctcattggcaaaactggagagtggaagacaatgaagcaacattttgaaaatctgtaattttaatgaatttcctctggaagctcatccaaaaaatgggaggtaaagaaaggagagaagggaagggaatttacagcatgatgttgaagggaactcccaggatagtgattatttggaaggctagagtgagagctattccaacaggatattggaggagtccagggtggatgtttcaaaaggaaaaaaatctccaggtgtttggccaaatggaaataagtcttagtgttctgtatgagagtttggggataaactgaagctaaatacatagaaaactaaggaaacagaaaatgagataattattatatccaagaaaaatagagagaaattttttaagagcataaatataaatctagtgtacattttgcctcataatagttttcagtcacctggttacataaatatggataccaaacactgatttaaaataatatttgaggtgatagatatgctaattgaaacattacattgtatccatatataaatacaattatttgttaatgaaaaataaaacctttaaaaagtttttacctaaaagcaaaaaaaaaaaaaaaaaaaaagcaatgctatacaagtatattgagaaggtaggggatgaaaagtgtgtatgctagaggaggtacaggagttaaatcttaacattttaatgcatgagttaatgcataattatttttaattttaaaaatatgaaaatattgatttctctcacacacacacgcacgcaaatacacaaacctgttaaaactgttgaaggctattctccctgtagaatgagatttaagggtaagtagggtacaggagtgaggattgtgggtttttttttcgcatcatacattcatatacttttatcttgcataaaaatggtataatttgtatacattgttttatatgtctttttctgtacttaaaagttttagattaccagaacacacagctcctctccttggtaaataacctagggaaaaggttaagaacctaagtaggtgggaaatacaatttatactgtcaaggatacctgggcataaatgcaaagggatcatgacatcactcccaccttgtgaagccagcttgtccattggcctggtgggcaaagtgggcagggagatgtgggtggggggtaggaggtagactggaagaggaggagacaccttggaagttatcaatgagggtgtttttttttcttttctcaacttttattttaggcttagggtgtacatgtgcaggtatattacatggataaattggttgtcactggggtttgggatacaaatggttttgtcatgcaggtagtgagcatagtacccaataggtagtttttcagtcctccccactccactcccctctacactctacactcaggtaggccctggtgtctatttttcccatttgtgtgtccatgtgtactcactgtttggctcccactcggaaatgagaacatgcagtatttggtgttctatttctgaattaattcgctgtggataatgatctccagctgcattcatgttgctgcaaaggacaaatttcttttttttttgtggctgtgtagtgttccatggtgcatgtaccacattttctttatgcagtccaccattgacgggtatctaggttgattccatgtctttgcttttgtgaatagtgcagtgatgaacatgtgtgtgcatttgtctttatggtacgattcctctgggtatataccctgtaatgggattgctgggtcaaatggtagctgtcttttaaattctctgagaaatttccaaactgctttccacagtgaccaaactaatgtacattcccactagcagtgtataggtgttcccttttctctgcaactttgacaacatctattattttttcacgttttcataatagccattctgactggtgtaagatggtatctcattgtggttttgatttgaatttctctaatgattagtgatgttgagtgttttttttttcatatgcttgttggccacatctgtgtcttcttttgagaagtgtctgttcacgttcatgtcctttgctcatttttttttttttttttttgaaacagagttttgctcttcttgcccaggctggagcgcaatggcacaatctcggctcaccacaacctccgcctccccagttcaagcaatgctcctgcctcagcctcccgagtagctgggattacaggcatgcactaccatgcctggctaattttgtatttttagtagagacgaggtttctccatgtttgttaggctggtcttgaattcctgacctcaggtgatctatccacctcggcctcccaaagtgctgggattacaggtgtgggtcaccgtgcctggccctttgctcatttttaatagggttgtttgttttttttgcttgttgatttaagttccttatgcattctggatgttagatctttgttggatgcatagtttacaatcccatacctaacatcatgctaaatgggcaaaagctgaaaaaattcctcattccaacaagacaagcatgcctactctcaccactcctattcaacttagtaactggaagccaattactctttagccagaggcaagagaaagaaataaaaggcatccaataggaagagaggaagtcataaccaagaaggttaaagatctctacagcaaaaattacaaaacactgctgaaaaaaatcaaagatgacacaaacaaatggaaaaacattctatgctcaggataggaagacttaatattgttaaagaggccatactgcccaaggcaatttactattaaactaccaatgtaatttttcacagaattagaaaaattattctaaaattcatatggaactaaaaacaaaacaaaagaaagacaaccaaatagccaaagcaatcccaagtaaaaagaacagggccagaggcaacacactacttgacttcaaactatactacaaggctaccataaccaaaatagcatggtaaaatacacatagtctatgtgtactaaaacagacacatagaccaatggaataggtcagggaacccagaaataaggctgcacacctacaactatcggatcgtcaacaaagttgacgataacaagcaatggggaaaggatttcctatttaataaatagtgctgggataactgactagctatatgccaaagattgaaactggatccctacctttcaccatattaaaaaaaatcaactcaagatggattaaagacttaaatgtaaaacccaaaactataaaatcgctagaaggaaatctaggaaataccattctggacacaggacttggcaaagattttatgacaaagtctccaaaggcaattgcaacaaaaacaaatattgaccagtgggacctaattaaactaaagaccttctgaacagcaaaagaaaccatcaacagagtaagcaatctatagaatgggactgttggttttcattataagctatgaagtagaatttgatttttaaaactatatatgtatattactttgatataaataaaaacctaaaaaggcactaaaatgcattgtagaatcaaagttatgagagagtaaagaatggcacatttttgtgacttttgtcctagcaactagatctgtaggtccttcctaagttgggctatgtttcccagagaggtaagggcaaaaaagactccttaaggatatatatctgagttagacttatctggactcataacaaatttcataagaaaacaggagtttttgaagtttttaatagcaaaactttagaaaaaataaatttaacagaggttaattgataaaataatgatttgagaatcagaaagcaccccccaccactcaaaccagaatagattcagagagactctatcactgccacatggtgggaagaaatttatggacagaaagaaaaagtgatgtgtagaatctggaaatggaaatggggtacagaaacagctcagttggttacagctcagtgtttgccttatttgaacatggttttcacagattttgttatccaaggtaggtcctgtatccaatctcccagggatatgagagatgactgtattttcctagttagctgagaggaatctagtgtcctgagctcttcttggctgtttgaaaaatggctctgtatctggaaatgccatcagctacatagctaaagcttctggaataatggtcttcgttctctgaggctggctgtcgagattagtgaatgaactctggggagtgacaagatgtcagagaatatggtttgatcatcctcacacccagcccctttcaaagaaaaacatattgagctaaaagacaacatcatcaacaacaaatcagtatattagaattacctgaaacagcttctaatcatttcagggcatgggtcaatattgtggataatcaccaattagaaacattgcttcattctagccagtttcttcaaggaatgtcttccatccgtgctatgcattatgatggaatattttgtagaagtgctatgtaaacagcttgtaccaccacagaacacggaaattcttaacaaacatgtactgcttaagtgcatgctaatgccacttttttcattttgtcaatgtaatacagcatatttaatgcattcagtatagtctgttgcgactgaaacagttatcctttagtgtcccagaagtctaattacaagctagctattctctttatctatgttctgatagcttctctattagaataaagaaactgtgtaatagaatgacttttgactgtgtgtttcaatgttaataagatgaggtttaactgcttctacaagtttatctctcttctaacactttgttgaaatgagacaggacaaactagttttgttacattttatgtaacattttagtactacctgctacctaatggtaaagagcaatttttattgttttcctttgatactttttttaaaaattcaaatatttgatgagtacctacaatgtttcagacattgttataagcagtaaacaaagtagaccaaattttattctctcatgatcttattctaatggggagatatagagtacactagcattaagtaaaatatgtagtacattgtaaggtgatcgtattatgaaggaaactgaagcaggaaggataattagctggcttgtaattcagtagaatacttgacttggaggtgaaatggttccgctgtgtctccacccaaatctcatcttgaattgttactcccataatccccatgtgttcttcgagggacccggtgagaggtaattgaatcatgggggaaattttttcctgtgctgttctcatgatagtgaataagtttcatgagacctggtggtttttaaagggcagttccgctacacaggctctcttgactgctgccgtgcaagatgtgcctttgttcctccttcaccttctgccatgattgtaaggcctccccaggtaggtggaactgtgagttcattaaacctctttttatttataaattcctcagtctcaggtatttattcatagcagtatgaaaatggactaacacagaggagaagtgtgttttgaagactggcagctacttactgatgtctaaaattctaccattaatgattttatgcttatatattattttacctcagtcgtgaacaaacgttccctttgaagggcttggtggaaagtatactgtaacagaagacaaatctagattttagtttcactcaggctgcctttgactttttttttttaattttttcttcccatattatccattcactagacttccaatagcatctaagggataatgattcccaattcatttctctagacttgacttatatcctaggcttctggactttctaccctaaatactccatacatatctcaaaaatcagcatattcaaaattaaactcactatcctatgatttacaacttaacacacttgatcattttcctgaattcccaatcttgtttaatggcatcatggttaaaatttctcatataatccaaagactcagtgttggtcttggttgttggcagatgggcattcagtggtggccatagccagattggccatggtgagtggaaatccacgtttctgagtccatgcattgtctccattcctgctaccatggctattttttttatgagcccattgggcaatgacaggggtggcaggggaaagaagctgactggtatacacagaatgagtcatcctatcctcttgattattacaatcctcctctggagaagccatcttgtggtgagcattcctatagaacacaaatatgttcagaggtttctttttgcccattcagagagactgtccatatatctcttccccaaatttctttgtcaccaattttttaatcatgttccttccaattacctgaccatgcagtcaaactatgctttactggccatgaattggtatgcaatttcatgtctggccatttttcctttcaagcaaagtgaacaaccaagtgtactgctcaaaattctgtccacttggaagactttctcttatcactgtccttcagggatttctcagagagggactataatgctgcagctttccacttttggtggtgcttgtgtcttacagagaaccatctgtaaactaggtctgagtcttctcttcttctgtcatctaattgttaggaacttcccatgaggtcataggcacagtctgggagggagaaggcagtgtagcaggagtggggactctgggtatttgggctaattcttcttgtaacttacttggccttcagggcctgcttcagcctgatcacatatgtgccacttctatttgatgatggagtgttgctgtgcacatccaactttatggctttttgggtcaaataaaactcagctgatgagaggcagatcaggttgcatggtaacatggtagcccatggtcaagtgtttagtctttactagggcctagtagcaggccaagagctatctctcttcttctgctgcaggtgatagcagggtgttactccaaaataataaaggactgtgtttaattttacttataggtgccttcccaatccttcaaacaacattcctatttggcagtgatgattcagggaccattggatctgctagatcatatggcccaagtggcagagcagtctgtgcagcaggctgggccaattgcagacccttctttttttccaagtcccatttaaaactagcagctttgggggtcattcagtaaatgggccagagttaacaccctcacataagacatatgtgtgtctaaaatctagagggccactagacattgtgcctctttcttgcttgtaggatggggcaaatgcccaaacttatccttcaccttaggatatctcaacattctccatatcctggaaattttactgaagaagacttctgattttagttagatttatttcccactctctgacatccaattgtcttattaataagtctagagtaggagctactccttgctaactaggacaaattagtataatgacatcaatgtgatggattagtgtgatgtcttatggaaagagaaggcaattaagatccttgcaaactaaactattacatggggctggagagtggttatatccctgatgtaggacagtgaaggcatattactagccttgccagctggaagcaaactactttggagggccttatggacaggcatggagaaaaagatatttgccaaagcaatagctgtgtaacagatacaagggggtgtgttaattttctcaagtaatgaaaccacatctggcacagcagctgcaattgatgtcaccacctggtagagtatataataatccactaccattcttcaaatccatctgtcttctgtataggacaaataggagagttaaatgggaatgtggtgggactcaccacccctgcatctttcacatccttgatgatggcactaatctcggcagtcccctccaggaatgtagtatggcttttagcatagtacttttctgatagagatagttctaatggatcccaattagcctttcccaccataacagacctcattccagaggtcagagaactagtgtggggattcttccagaagctaagtatgtctattgtagttatgcattctggaactggaaagatgccacagaatagggttggggacccactagacctattgtgagaagaacctgagctaaaactcagttgatcatctgacctctatgtgcctttacactgactagtgggcctcagtgatgttttgggtctccttgaattagtgtcagttcagaaccagtatccagtagttcccaaatgatctaattatttcatttaccctaatgtacatttactctagtaaaaggctgtagatgcctttggggaaagctgggagaaagactggtgatatctttgacaatgttcttctcaaggagtcctgtcctcacgtgcattcaagggattctacgtctgtaaactggtttaaaatttggaattgattgaggggccataactgtatttttttaaagtttacattagacttttacctggaaatgttctgctcatacatatcaaacaatttggtatactttctatctgtttcacttttagaaacatcatgatcaattaactaatgccataattctacataagttaaactagtctgactgttgctttgattctgcttttcatcattggtaaccctgcccattgtgacttcgtggttgagttctgcaacctgacccctgccatcctgggatccagttactcttttaggtttcccaattcagtgacagtagctcatattaggaggactggcatacagagaagaatactcacagagctcttattgttgaaatatatgtcttctgcatccttccaatgtgggtgagtagggtttaagtgacaaatccacataaatatttcaaatttgctcatgctgagccatcttttggtccatgtttcagccaactaaccaatcaaacagttagagccctttctaattccctgagctgcaacattacatgcaaaatctccacttagtgtgtccacgtcgatgaattcggactgatccaactttatgttccgtccagtaacatcccacacccttagcatccattcccccacacattccctggatttctttctgtataaatcaggaaactgaagtagttcctttgaagtatggctcacctcttcatgtgtcacacattgtacctcacttggaggggcctgctgggatttgaatctagttgtacatctagaagcaaagaggcatgatgggggtgagtcctgaggagaatcagcattgccttgcatggcaactgcctcagggaaggtcattactgtttcctcagacattgtagtgctaataccctcaaatagagatggaaaggacaatgccactgtgaatgaagaggatgataccactggaggtgagtatgtcacttccactgaggatggggatgctgcttttgcttgggttgaggagaccagttcctctgagtgtagggagacctcgtcttccactggtaaaaaataaaaaacactcatcagatttacaggtttattgtccccagcttaataatgatgatcccacatatccccattccaatttacaggattctattcccaattaatgccctcactttaagagtagacaccctgtgagctgtggaatacggcttgtgttttaatttagctagtaataagatgaggttctgcatttgatcttcagcaacttcagccctgcagctacaggagataaagttaatcataagtggttagaggtattacctgcaggatgggtacatgagctcatgaagagctctgtaagacacaaagtatgggataaggatagaataacaacacattaagtcctacggccaaaaaaaaaaaaaaatgccagaaaaaagattgtcagagaaaagagattccccacattatgactgcatacagtactgccttggtatcctaaggatgctaaccctcttttatggtcatagtggaaagaaaggattgcactagtggcattttgaacaaaggacaatgacaaatagagcaggagaggaaaaaaaggaatctatttcttaccttattggtcaaaattaggagccctttattctaatgtgaaaaaaatcactgatactcatccagaatttagttttaaggatcttaggcaagatggttagttggaaaagtaaacattctctttgaaatcaagcagatctaggttcatatcccatctcttccagttgctgctatgtaatctgagaaaatcacacatcttttctgagtattagttatttcaaacatttaatgcagaacttattaagattattatgaacatcacattacaaaagtgtaaaacatagacctatgacatgatttatggggtatcatatatacccaacaactggcattagtaataattacaacagcaataacagtgaggtatttcattaatacccaaatctttaggaagagaaaggatacaaattttgacaccattcatgaatctacttgaagaagatacttaaaagaaaataaatgtatttgcattattatctttgtcagtcaaacttaagatagcaagaagggaaaggcagccagagaaacatggaaatgacctatatcattttcagtgtaccttggtggctgatacacgtatcttaagtccagtagacttttgagcaaggtacatttcatggtctgtctagaaatacacaagcactattaatagtcctgtttgtattatctgtgaagtttccagagcacataatttatagttatgagtctacagtgtcaacctatttttaatccaaagaaaaaagattgcatgtatatttatttttcaagaagtaaaagttaataggagagaagattcaggatatcttgtttatacataaatttacatgttgaattatctatttgcagaaggtagaatttacattttgacaaaaaagtgttcattagttttaatttctgctgatgttgaaaataatccaaagtacaaaagcaaaaaaaaaaatgtgtgaactcttgaaccctccctgaggttttttatgtttgctgatgtgtaggcacagtgatggtgtcaggtgttcatggctgtggaattggatgtacagaactaaagactccaggggtcctattggcagctcatgatctggcaattggtgaacattaaaatgagaaactctaccatcatatttatgttcagtaaatcaggaaatttcactggggttctagtcaatttttttagctgtctcttttgtaaataattttgctcaggtattagttctaagacatgaatttaataccataaatgagaataatgataatgctggttaatgtttattaatttttaatatacgccaggtctctatgaagtgctttacatgcattacattatttaatcttaaagctgacactattacttaggtactattataatacacactataaggaatctgagagttacaggtaataagtaaattgatcaagatggaacacagatctgtggcaatgttgtttgtgagcatatttttttggcatattcacaaatgcctaattcttgcttgagaacagtgtattaatagaataatagttaagggcatacttaagaacctggaatgaaatctttaattttctgtgtgaccttgactaagatttttacttctttaggctttattttccatattttaaatggggaaaattctaatagtttctatcatgtagattatttgtagtgtttagataaattaattacatgtgaaagatttatgacagtggttgacaccgagtaaattccttaaaaaaggcccgctcttatatctaggcatttatcagaaaattaaaaagaaacattataaggaagaactttaaggagctagcaactgggtaaatcagactagatattgaaaatggaacccactttacaaattaaatccatagacaaagttcagaatgagcttcgacttaagggaacttgcctcaaccatctggttcaaactcagagtccatcgcttccacaaagatacatgctggcccatctgaattgacatctgtgtgcatactgaagtcctggaggataattaggagagaaaactccaacagcattactgacataagcctggggaactaagccataaaattctctatataaacaagtggcctatataaccacagaactataaattttggtcttgccccaggagtacctgaaatggccagatgctcaaacaaaaataaacatttctgaagtgcacagcaaacaaggttttaaaaatcacacctctctgctataacctttactcactattaggctgatgaattcatgctaccttgtttcatgacagctgtggatgacatctcatgaccaaagcatagagcatttctctgatttaccacagattttgtaacataaagtttttattgaagtatagcatatataaaatgcatgaagccccagtgtatagctcaattaattttcacaagcaagtgtatctatgtaaccaggatccagatgaggaaacagaatattactggcatcaagaaactctctatggcccttctagtcactaatttctttcaaagatgaccactatcttgattcgtaacactggatattggtttttgtctgtttttgaaagggaatcatacaatgtgtattcttttatgtctgacttctttcattcaatgctgtttgtgagacccatccacaatagtttatttattgtcattgatgtctagaataccattatgtgaatacaccatagtttatccattctactgatggacgtagggattacttctacctttggtagattacttctactttataaatcatgttgagaaaattttgtatgtgtatttggtgaacatttttactcattttaataggttatatatctgggattggaattgccagattttagtacaggagtagagtcagattcaatagagacaaattatttttcagagtcaaagtaccagttttcagttccttgagtaatgtatcagaatcgggttaatatttttctcattaaattaaaaatattgacggaaaatgcagatattaggcatggacttcaaagagaatgacaagtgtatacatttgcatatcacaacttcaattaagatataccaactttccatcacctcagagttgtcttgtgcctgttccactcattctgcaccccagataaccactgttgatttctatcattctagaccatttctgagtattcttgaatctttataagaaaggaatgatattcctgggtcgggcttcttttctcaacctaatgtttttgagattcatctgtgttgttgcatgggtcagtagacattctttgctttttcggagtaaaattctgttgcgtgaattgtactgcaatttgtttttccattctatgttcatgaacatttgggttgtttcaagtttgagattataatataatgagtaaagttgccataaaaattacaatacaagtctttttgaagacgtgcattttggtttctctggtgttaatattgagggaaaaaattgcttggtcataaggtaggtacattttaactttataagaaactaaaaaaacaattctgcatagttgaccaattttccaacctcactagcaatattagaaagttcttggccaggtgcagtggctcacacctgtaatcctagcactttgggattccaaggcaggcagatcacttgaggccaggagttcaagaccagcctggccaacatagtgaaactctgtctctactaaaaatgcaaaagttagtggggcattgtggtaggcgcctgtaatcccagcaaattcggaggctgagacatgagaattgcttgaacccaggaggcagaggttgcagtgagctgatataatgccattgcacaccagcctgggtgacagaatgagtctctgtctcaaaagaaaaaaaatgttctcgctgctacaagtctttgtcaacatttggctttctttgtctttgtaatttaatcgttcttatgggcataaaataataccattttgtggttttgagatttatggtaaaaattacattgaatgtcttttaataagcttattgcccaagcaagtatttgctaaaatgtctgtttaaactttagtccaagttttttttttagttgggttgtgtgtttttacaatagattttgtggaaatttatatattctggattcaattcttttcttagaaagatttaagtatttcattctaatctatagcttgccttaatggtgtattttgaagactagaaattttcaattttgatggagtccagtttaacccttttctttttcatacttattggcttttttatatcctctcaagaaatctctgcctatcacacagtgcaaaaataatctcctatatcttaatttagaagatttataattttacctttttaatttagcactataattgatcttgaattaatatttgtgtgtggtctgagataggcatcaaggttcatttttcttctaggtatttatcaagtttttcaagaaccatgaaaaagactctctttttttcctctttgtatagcctcagtgcatttgttgactattagttgagtattcttgcaagtgtttttctctggactctgcattttattgatccatgtgtctatttttatgtcactaacatattgtcttgattactgtaactttatagtgaataatgtaatcaagcagtgaattttccaacattatttctttttgagtaaatttatttgggcaaatacagattcttgctactccatatacaatttagaagcaacttgcccctttctgaaaaaagcctgttgattttgatttacactgtaacacattcatatggtttggctttgtttccctacccaaatgtcacgttgaattgtaataaccaccacatgtcaagggcaaggccaggtggagataacggaaccatggagggtggtttcccctatattgttcttgtgatattgagtaagtctgatgagattagatggttttataaataggagttcccctgcacaagctctcttgcctgctgccatgtaagacatgcctttgctactccttcaccttccaccatgattgtgaggcttcccaaggcttgtggaactgtgtgtccattaaacctctttcctttataaattacccagtcttgagtatgtctttattagcagcatgtgaacagactagtagacacacctatagacacatttggggaacatgaacatatttataatatgaagtcttctaatttataatcatgatacatctctttatttatttatttatgttttcttgaatttattttagtaatgtgcagtttttaccattgaaggctttcatctgtgcttttaaacttacttttaagtattcttaaaactattaagaagacttaaacactcttataaatgaaatgttaaaaagtctttgtttcaattgttactgctatattgaaatataattgcttttgggatatatgccttgtattctatagccttcattatctttttaactctagtaattgctttgtattttatttaggaatttctatgcaaactattataccttttagttgaaaatagtagttttacatcttcctttccaacatttatgccttttgttgttgttgttgttgttgttgttgagatggagtctcactctgttgccaggctggaatgtagtgacgcaatctcagctcactgtaacctccgcctcccaggttcaagtgattctcctgcctcagtctcgcaagtagctgggactacaggcacatgccaccatgcccagctaattttttttttgtatttttaatagagatggggtttcaccacattggccaggatggtctcaatctctagacctcgtgatccgcccaccttggcctcccaaagtgctgggattacaggcatgaaataccatgctcggccaccttttaaaaattgtttaatgcaccgaataggaattgtaatattgtactgaacaaaagtagagagtgtattttttgccttgttccgaattgtaggtggaaaacatccaattttttgctatatttggtagatatactttatcagattgtggaaatattcttctatttttattttctgagtttttattgtgcatatgagttaagttttatcaaatgcttttattcattaaggtgactacaaagttttcttttacattattctattgctagaataatgtaaatcatactgatttagtttcttttggatattaaaccaaccttgcattttaggataaaaatctcttgattatgatgtactatccaatttatacattgctgtattcaatttgctatttgttaagtatcattgaatctacgtgcatgaagagtactggtctataattttatttttccaatatacttgtcaggtttttgtgtcagggtttcttttctttttctttcttttttttttttttttgagacagagtctcgctctgtcgcccaggctggagtgcagtggcacgatctcggctcactgcaagctccgcctcccgggttcacgccattctcctgcctcagcctcccgagtagctgggactacaggcgcccgcccccacgcccggctaattttttgtatttttagtagaggcggggtttcactgtgttagccaggatgttgtgtcagggtttctatggttttatacaattaatttggaagtacttccttctctttaattttctggatttgtacagaatttatattatttcttccttaagtttttgttttcatccttgaaactatgtgtgcttggtgttttccttatagataatttcaataacaaatgtaattcctttaataagtatagggctaaacaatttttcaatttattttattaattttgaaatgtgattttcatggcattagtccattttatttttttgaatttttgcataaatttgtttataatattgccatattatccttttaagtatctgtaggttttgtaatgatatgttctataacattacaaatttggtaaattttgtttcctctttttttgacctgcctttctatgggttattaaatctttttaatcttttcaagaaacaatgtttggctgtgttaattttttctgtttgcttgccagttttatgctatttatttttttctagttactttggatttatctattttatatttcataatttccatgtgcaccttggatttttacttccccaatttaagggatgtagaggaggatacagtagagaaagggagaggtctgtctgcccattttgccatctgataggctcttttgaaaaaggccattgcagcatatatgctaagttaatttagtcattcctcccaacagaatgtttgacataaagctatcaattatcaacacagcagcagccctatttgtagtgaagtgtagtgtcccaataggataacagtatactgcttctaagtaaaggaagggattgtctgtaagcaccgagggataaaataataaaagtaacaacattacaagtactactcaaaaaaccaaactaacatgcattaaatgcttacaattatcctggagctttacattttcgtaggtattattttcccagtttacagatgatgaaggctttaaacagttaaataatttggtgaaggtcagaattcataagtggaggaattaagattgaattccagctcttctggacatcaaagcctctttgtttaaatatttccattatatcaactcaattatacttcaatgttgttaaatttttattgacataccaacaacataaaactcttaaatatacagcttgatgaattttcataaagcaagcacaactaaattaagcaacaaacttttcagcacccagaagcctcctttttatgttcttctaggcattatgctcttgttactgccctgactttgaaaacattgattagtttacttgtttttgtacttttggcataacacagtatatattcttccatgtctggcttcattgtttcaatatctatgaaaatcatccatgttttgtatagtcatttgcagtgctttattatattttattgtatgtatataccaggatttatttatccattcaactgttgataaccatttggttagttttcaggttcagtctattaaaaataatgttgcagtgaatatattcttatgcctatcttttggtatacctgtgcatacatttatagaatagaactgctaggtcataaaatgttcatgcatatgttcaggtttagtgaccctgttaaatagtattccaaggtggttaatcaaaaagaaatttctttagaaaggaaacttaaatactttcataaaggaaaactagtatccagaccataatgcgaatatttaccatgaaataaaaacataatttaaacaaaaactttgttaatattgtgccacctagagtaatttttgctgccataaaatgtatatcttccatacgttgggaaattcagatctataccagttattagtaattaatcatgtattgtctagtcttgttatattgctttggctgctatttacaattttgaaattagatgcaattatctgtcttatttcttttctttgaaatggcagagacattacattatagttctttctatctcatttgtatcactaaaaatttcactcagtaaaaagtcttaactattgtatttttgttattgttggcaagtttaaagctacctgtttgctacattttttttaacctttgagctgataaagagtactttgacttgtatgcttgtgtatgtttcatttggtgcttattgagtatagtcacaaaaaatgcttaggcactggagtcaacagagatggatttgagtacccttacaccacccctttgccgtgtgttgtttattccacttaataattctgagtctcataattatattttattaaataagaattataatgcattgtatcataaatttatatgaggattaaatatgataatggactttacgcttttggcacaaagtgggtcttcaataaatgataatttacatccatagattttctctcctttattgaaaattaaataattaatatatctttatcaaatatgaaatttgtttctagaaattactttctttaatatatataactttatattttaatatgcatcaatctatatttaaaatatatcttaattctcaaagtttatgccacttctaagagtgtgtatatttattcctcctttagagtaatttaaatagagagaatctgacttattaatgaactgtgcaacagcttcataatggctaaccttgtgtgatggtcagtataacctgggctttgaaatcaaagaatgtagaagcaactatggctctaccacttccttgctagattgacaggttatgtgacctctttggattttgatgtcctaatctacaaaataaggataataatacctatctaggtgcccaatatacaatacaaacgtgcattaaataataatttttcattgaaactctctacttttgcttttcaaataatgacccaacatactttacataatggaaggaagtctcttctaagcaagagagaaaatactttactagagtttcagctaggaggcacattaaatggagtgtagttttttagaaaataacaagctcatcttttttagattttttttttcttcattgtgctaagaaatgtacaaatgagattcaggatcatgaagcatttctcaatgatttagaatctgaaaacttcaaaaaattagacacaaaattgttttcttagagtactgagaattaagtctgttttgtatctttctgctttactaacaaattcatgtttgtgtgtcatatatttgtctgtaaatgaaacaataaaatacattgttcaagtacctgattgcaacatcattgtcacacctgggatgtgatgagtcctctgccaagtgaacatgtccttgacctgaagatttcatttcaggaatagataccacattgatccaatatttttaattgctggcaatagcacaagtggctaatctttcttcgatctttcaaaatgtcaattttaatttgcaaatttaatacatgcaaaagtatagaaataatcaaaatacttattttaaatgcaagttaaaaatgtgcttatttcatttgtttcagagatctgtggctcagaaaattagaaacaccaattttagtaagctcattagttaagttcaagttaagaaagcattttaggtggacaaaagctggaatgaaatttgttaataaatagaagttacttagaaagtttgatttaattgattacacagcatgagtatatgaattcagaagcagtgggaaggactatataaaaggaaaggacacagataaaaacaaacatatttggatctggaagctgtctgattgttgatgtacatttagttgtccttctctggtggttcaatgaacactagtttcaatagtgttttaagtcaggtcaggggctgtcaaatttcagcttcgatcttgaaaaattttatctgatttaatttgggtggcaaacacccaagccgacttcttcatgtgcaaagagtagaaaactacccagttacttatgaactctgtgtaacacttgctaactcccacttgaatatctgccattatttaatgcttatctctgggaattcctgattttggaagccaatggataaaacaacagttgtgcatgctgccagcagaaataatcaccattgaattaactggctaggaaccaactttactattttctctagtgcttataagctattatatttatcatttaatgaatacataattccaaatataaatgtctcaaaagtgtctaataagaccaaatatacaggtttgatttcagtatttggcagaatactgttctatgagaaattttccattattaggaaaggcagcacttaagaaatatttccattactctttccactcttactcgcaaaaattgttttgtctgattggcaaagtgagggtctgggacctgttgttccaccttttgtttttgagcttgaggcagctagctgggtaagtgtgttacagaccaaatcttatcaccagctgagtccaaaggactggagaaggggcagggagcctacctgaaattacaggtttagggaactcgcaataaagctgctaccttgatcaccttgatctcgactcctctatcttcccctgaattgggtctgaactagaagaaagaaaggtaagtgatttattggttccctcatccctcagcctaagtcataaagttatgattccaatggacatattaagagattatcagggaactctatattggctatgaaagctgagctgctaccatgaatggagtcagtcatttgcacactgcaggaatttggggccacagcgatcagcattgctggctgtacttgatgcaggatcagtggggagagctcaataaatctctcgctctcacaggagagtgggagctattgatcgccagtggctccattagctctgtatgacttcactggaattaaaatctttagggcttgatcctcccctcagatagctatatgtacacagggcctaatctaaccttgtacaaagtggtgagatttttttttcttctttcccctcccttacccaacatctaggtatttgagatgagcaagcgctatcctgcagaattttaataggcctatgtttaaagtagtgtctctgacctttatgaaattaaggagcggggagagcattgccagtaagacttaacagatcatttctgtctgctggccaatctccattggtgtatgtctatttttttctaaaggaaaaacagcctttcacaaaaccagctccaaagctcatcaagatgcaattgaaatgttgaaatcaggtaaatcagctcttattaaacatgaggaactgaggcaagaagacgcaagttttttgtttgtttgtttttctcactgtagaggtttttatcacccagatgcacaaaatgtggccttgttataataataatgtcctaaagtatttatgttgcttttctcttaatttttgaatccatcaatagttacaaactaaaacttttttctttgatgctatcagaggtgtagtactgtgtatggctactgaaaattcaagagcctttcacttgatgaaaaaacaaagagcaatgtatctttttccaaagtagcattatcttcctgttacctgaaattcagagatagatattgacatggccatttctcatggggattaatacttatccatctaatgggtccatttaaaagcatatatatggagtctgagatttggaataaggctttttgtcaaaaggacacctttatcattgggattgtttgatggaaaatcacaaagccatatatttgtgggaaaccacttagaaagataatgtaaaatatcatggcaactgttggcagaattttaaaaatacaaaccacaaacacatattgtaaaatgtattgacctatatattgtctagacatactcaaggaactatttccttttagacagattatttgggagactggacactatctgtttccagattaaaatttatgctagcttacagataaacgaaaggtagtctaattcaaactttgtattgccttaatgctgttagatagactagatgaccctgaatttccttttaaccttatgattagagaaaatcacttttctaaacaaaataaactgttaaatattagagcttatgaaaatatatttgatcaattcaaaaccatcatatgtggtggccttaattgtagaattcaaatatatctcttagtcaatgacaccattaatgattatttaatgggaagcctaaactaagccctaaaatagcttgaatagaaatggaaaaagtttattcatttacatattcatagtctgcttttaaaaatcacaaaggttttaaacatgaattagaaataaaattcctatgtcattattctatagtcttatgggagaggtaagtaagagcaaaaggactccttatcctctatccgcaaggaacagataacacacacacgtacacacacacaaatggaagtatattcatgggaacctgaaagaagcaatttgagatgactgatatttacaatttagtggagcaaggactgaaagaagaatgtgtcttgcaaggggcacatgagtgatgggttttgcaggggatgtgcaaacactctgcttttagaaataggtctgatcttaactggcaggtgaccgtgtggcagatttgaaagcattctactccacttctcctcaggatacaaagaggtatcttgaaaaagaggaaaggataagtcaagatttaatgatttaaatccttgagacaaagcattttaaaaagtgaacttgagttcctcttcacgtgtttaagaagtgggccttatgtttacaatttagtagatggagtgcctgttgtttcacagtacagtcctaagctctgtttcttgcttagcactgaatggttgcttcatgatgggtaagtcacttaacctttctgtggtgtgttcttctcatctgcaagtagagatggaaatgctcactggggatgtgttgctaagattaggcaatatgtaattgtgatgagcattatacatgctaactaatgatgataatgctgtctattagagtgaatatttggatcggagggcctaagcagttttgtgattgcatttcctgcagagagagaccttagcaaatgattacctggtccatatgactcatgttttataacagaataagattatgtcgtctcaaatccttcccctttccccccacagatcacctattaaatttttttttttggaattaaatacaaaatcattctgtctaggaggaggaaatgaacagcacgtcctgggaaagtcgtttctgccagctcctctaattctttaagttataattttctttcaagaattccaaatttaggcattgagccttattgcaattttcagtggagttacgcaagcttatacagccagatcatgtctgaaggttatcaatttgttaaacctgtaatgtcaagatctcctttctttccaatttgtagagaatgttacttccttagtaatcttattttttttctctctttctgtcttctaaacccacctcacttgctcagattcttaacagggttaaaaatggtacagccagaaggaaatatctctaatcgccacctctgtaatacagacacaagcattttcttaagggccaagagactgctaccacctctcggtttcttgagatgttcctaatggcatgttgctatgttctgatgtgagtataatggcataagatcacagcaagaaaaatgcaccttcccctcaaaagcatagatctcactagaaaataagagaaaaaatctctttactttggtttttaataaaatcatactttccagaaagatggaggtgagagcagaggcatgaccgcttaatttcaaatgtgaattttttttctttcttaaaggagacactatggtaattgcatctcgtgcacacttagtaattattcatttcaaaatctactcctgtgaattatgcatgtttgaggattaccacacaacccaatgaagtaattaaatgggtacttttcttcccattttacagatgagtaaaataggaccccagaaagaaacaattgaatgttcaaagctttcaggttttttttggtaaccaaaaaagtgctagagtttaagccttctaatataaacacatttttattatgtatacaagttttgaatagatttatttctgaatctaattctaaagaaaaatggagtttctgagagtcttttcaactttaattttaaatataataaatttcagaataattgttatgatttattctgaacagtttaggtggaatgatataatttcaggggcatgagaaaaaatgtcttctactcctccttaattatcatgccatatgttcatgaagggattttctcttctttcattccaaattagagagaaggcttaaaaacaaagtcctctgatggagatgacacaatgcctgagacttgtgggaagccctgactcagaccttttcctgtaagcatgttaattgaagagggagacaggatgtgtgcaaagcagtagttctgccctttaaaggggagctaagagtgaagaatagtgactcaggtgatatacaaaatggactttacttagattacaatttagctcaggggtatcctctggagaacttgtctgtattgattggagcccatgctgtgtcaatggaatgcccttccttggatataccaattgctgcatatgctggaacatttggcaacccttgggggcccccacactgttttacagccagtgacaacacaggcagcacagacgggcaaaacatgaaatcagagagagcaaacctttcccccttatctggaatctacacattgatttacttatacaaggttttcaggtcgaaatggcttatctattatttctctaactggcctagtgtattctctaaggctaagcttaggtggtattggtattcacgaactctttacagtatatccgaatgcttctgcttgtatactagttcttaattgtggtatgcagtctgtgacaaccatctgctgaggcagtcacatttctctcgcattcaaacccattgaaattaaaatattgataagaataatttcacaaggtggtaaagttaatagaggaattggagttggtatgctttttgaatttaagttgaacatttagagttttctgtaagcactggcatgaggttttatgctgctgagcatgggtcatttgtaaattaatgcttctatctataatgaagaataatctcttatcatggccatagagtatgcagtacatagctctgcaactttagcagatttttctcattttttttgtatgtgtttcctagtttttttttaagagagaacataggtacattcagaatagttgtatttatgagaaggatgttactaattttttcaacaaatatttattgagatcttaccaagaatttctgctgagaaattcttcagaacatttagttaagatatgttaaaatcacatcattgcaattttactgtaatggtaaaggcccctagtgggccaattcaaagactcattctaggtaggaacattttcaaagaaagtagaatgactacgtagtaatatttacactaaatacgaaaaccagcatacgttctgtcaaagattaggcttttgtctgagagctgattggctgggttgtgtaattagtctcccagaaagctaattctgttaaataatttataattctgttgaagtttattataaaattgctgaagcatgttatcaggaatgcctacttcttccttgagagaggtttgagaccatttttcttttgttcacgtgacagagagtatgccaagtgctagggctgcatagatgagtggatcaagatctgagcccctggaagaagttagaaaataatctgaattaacagaaaagcaagtatgtcagagcagtaaaagacagcctgtgttggcatcaggaatgattccaaaggagagagtaagaaattgaatagagggttttgggtagtaggtcagctaaatgaaagaactcttcttggagttaaattctgacagataagtaagtttttgtcagggggatagaaggaaagtgtagggaagtagaacgtggaaccaagaccttatcttttagaggggctaaaaaagcataaattaagtgttctgcattgcaaaatgtttggagatctggatcttgtaagcagttttcatggagcttatagtctagtaggggaaaagattagacgattaaaaactcatgcatatgtcttttaaagaatgagaggatactatgaagctgtcgttggtaatattcaaaccaaaagcttaataatgagcacccagatttaagaaagtaattaggaaagaacatttcattagaaagaacacttagtctcgtgagtgacagccaggaattaggaaagaactatctgtgtcagaggaattaaaagattacatcatttttggaatagggtgagtgaaaggctcaattaactcaagagtgtttagttgaaattatttagcagccaatcaatgcataattcacacataatccatttacatttttagcaaagtgataagtttagataataatctagattagggtaataggttacattctagcccattgtctagttttgtaaataaagttttattagaatacagccatactcattcatttatgaattattgatagttgcttttgttttagaacagcagagttgagtagtaatgaaagagactccatggatccaaagcctacaatgtttaccagctgccttttctcagtaaaagtcaagtcctgatcaacgtccttgtggtttaatataaagtgcactcatacacatagtcacatgcacacacacagaacgttgcttcagtaataattttcatgaattgaaacatgaatatgtaaatcctgattggtggtgagtggatcctctattattactaaaattctctttttggaaacagttctttgggctacaaccacccagtggttgtagacaaccctgaggttgtcaatttttccaaggtaatgggtaagaaaaacagaaaagtctggactatgagggaagagtttagaattgctagttttgttagattgccttagggtatattaattctataatcatttttacaaataaatcctcctcatctttaatttcaggaacaaaaatatattgtaatgtgtagagcttttgtcttagcaagctacatggtacattattatatgtaactgacaaagtttcagaattagaaatatacaattacaggtatctgcatatttcatcattagtaatgcaatgcagctaaagggtcagtaaaattttaagaagtttgtattttaaatgccttcaaatattgaatcttgattttaagtggaaattataacagtcatatatttgagaagtaatacacaattaatctatttttatatgctgtatcatgatttgcaatttcgaagtacagaagaaatagaaaatacatgggcaactcaaaccaaatagtaaactctttaaaaaatgcttttagaataataacatataaattataaacactacacatacaatttaatgtgtaacaataaactaaacctctgtgtatctcctacctcgcttaagacacaaaacgatatgagaaaatttgatatcccttgtgaatttcctaatcatcttccccgttttcccagcagaaacaataacttccttaattttatgataatgatttgttttcctttgtaattaaccatatatgcatgtattcttaagcagtatgttatttaattttctctgttttaaaaattttacttaatctcataatgcttgtatttttctgcaatttgcttttttcattcaacatttaagatttttctacattgatgcttatagctatagtgcattcattttcactccctggatggataatattttatttatgaatatcctgttctgcatgtgacaggatatttaggttcttttgaggtgttattatcatgaccaatgcatctttgaatgtttttgcacatatctgaatgaatgggtacacaaatttctctaagaatataggaatagaattgcttggtcttgattatatgcaacttcactaaataatgccaactgcaattgaaccaattgacttcttcactagcagtgtacagggattcctcttgcttcaaaacctcttcaaaagacagtgttatgatactcttcactttttcccaaagtagtggtgaattacatttttaaaaatgtaatatccttgtttcataaatgggttttattgtgtcagctttgttccatttgcgtgcttaaccctgtgctattattatactccaaattatgtagtgtattcataagttttgataacaggtagggcaagttgctttacatgtcttttatttatgaaattattaattataaaatttttaagaaacatttataaaattatttagtttggtcttgtttttagaatttggcttgtttcttgaaacaagttttggcttgtttttagaaatttagaaattgttaattagacctttgtattggaaaacagcgacactaagtacagaaattttctccagtgttttgaagatattttactctcacccgtattccatttctgatgttaagaagccagcaaaagtcaaattaccattcccttgcaataggcagtttccccccaaccccggctgctcttacgaattttatttttatatttgctttctagtagtttaactgtaatatgtctaagtttgtttaaaaattatctcctgattaaaatttgttggttgtcctgaatcagaggattgggatctttcagcaattctgccaatttcttagatataaaatattcatttttttaaaactctggataaatgtatgtgggatcccctcacactgttccaggtgccctaacccgttttccatatttttcattgctttccccctatggattcactctccattttggataactttttcagacctatctttctagtcactacttctcttttcaattgtttctaattttgattttaactcacagattaagattttattttcagttattatattttcactgctatttatttcttctcaatattcctggtcaatttctaaagacatttatcattctacaataatttgaataacttcctttattttttaaattaattattttatattttttatctggcatttttattatttattatttttcctggctctgattttgtaatatgttgcttctattaattgatgattgtagagcactagttttgtgagttttaaaaacttgaagtcccattgtttggaactatttctgtagggattctagaggtccgtgtagaggtctgtgtttaaaagtgtcatatctcagcaaggaaatgtgtttacttttgacaggcaaatgggtgcagtaccaacctaggaataacttaacacctcagctgagagtttttcagtcaaaatggatcagaagtataagttctgatccaaaaactcttattagtatgttccttgtggttctaaaaaaatcttatggaagactgtgttggtttttgctattctaggcagagccaaagctaagagaggacttctttccccctctagttcacttaatttgtatgtgtgcatgtgtgtatctggggtgtgtgtgtgagtgtgtgtgtgtatgtatgtatgtttcccatctacagactaacagtaaacttaggcttgtttcctaaccctttatgcctgtggctagttaaaaatcatgtcccagccacaagaaattgaccaatgtccatagggcaaatactatcttcagcaaatgcttatttacatagaaacaaacttctgtgtaatttctggccttaaatttttcctttctttattcacattaagcccatacttcagaaaaatattttccatattttatccagaatcatttgttatatactaggagaggtggtttctttgtgtatagtctactgcattgccagaaaaattattggattttatttttcactgcactttaaaattgtgcttaaagggaaagtttacccgcaaccatagtgtatgtggacatcttcgtgtatgcatttctgaaatatctctgtcaattagaatgtaaaaagttaagtttcttattacctgttatatataaatgctctatgaattgacaaattattcagctctgtcttaataattttgataaagtaaactaatacaggattttggttatagactaaaactcaagctagaattatttgtaagtcttttcagatgacagaaaatagatattttgaccctacataaatatgctgttaaacatggaaagatggattaacatgcacctgaagcaagtttgtatttataaccttttgataccagtgatatttaattgggaatactagcaaattgaggttttgcgatatatataaaaaactgtcttgcaagaatatgttcataaagaattagaattctttatcacagcttgtaaaatgttaagtaacctagataatagagtaatataatttttacaatataatattgatttagttaatatcttgcttaaatattgcaatagttgtccttatattgaacatgataaaattgtatgctttatatgaaaaaaatcaattgacaatgtgaaaatggagttgagtttttcataaatatgcagatattattttctgagccttgccaaatgaattacgatgattttgatctgtaattttgaaatatttttggataaatattgaaatgaaattgctaatatagaaaagtttcatgtcttttcctattttttcatcttactggagatatatgaaaatgactcttattagttaaaactttctatttcgatggttgcttatttgtactatctgttggaattctatttattttagttgttatgaaaaataatctgagtaataaaccagacagtttctacggttccagtcaccattagtggagaggaagtggtacaaataagatatgccttggccaggcgcggcggctcacgcctgtaatcccagcactttcggaagccaaggcgggcggatcacgaggtcaggagatcgagaccatcctggctaacagggtgaagccccatctccactaaaaatacaaaaaaaaaaaaaaaaaaattagccggacatggtggcacccgcctctagtcccagctactcaggaggctgaggcaggggaatggcgtgaacccgggaggcagagcttgcagtgagccgagatcgtgccactgcactccagcctgggcgacagagcgagactgtgtctcaaaaaaaaaaaaaaaagatatgcctctaagtagccctgccaagacccacttctgtgaccattaaatagtacatgagcaacgctttatgaaaaagaacacacacacacacaaaaccaccaccaccaccaccaggtatcctctttttcctaacatatcaagtgggtaaaagaaatgaagagttattgaagaaaaagcaggaagtactaaccagcacccacagtaatgatcacccctattttaaaactaatccttctaaattttgtagaacttagctaattatttttcctttttggcatagttgtggcaaagtacggatgcagttttgctcagcctccttaataatgaaagtatggatgaaaatcttgtggggaaaactcaaatgcaccctcaaatgctccagctgttggagagtgaaaacgtctggccctgatgcctctactatatcatttgtttctggatctaagaacccaaactactgatgttaaatgtactttaatacactttcagtttttatacttattatgttatttgactattttctacaagtagcacaggataaattatatgtggcagaatttttaggcacaaagcatagtaagggtagaattgtcatatactctttgttttgagtcctgagtgagtggcgtgtgtattccaggctgttttagaatctgagtataacataaagagcaaggtttaaaaagtgatcctggttcagccaaatccctctaaaggttgctgttcacctagccagacagatttaggcaccagaatcttgactacaaatataatcttgcattttatacacttataacctttataccactccaaatattcttgacatttttgaacaatatttcatttaagcatttgcaaatacacaaatctgtaaatatcaccgtggaatatgactcctacaacattacaataaaatataactaaatttttgacattgtctctatgcctgctactgtgtccagtgatgataaatcaatagcaacaaagcaacactgcaatatagacaccgattacttgcctagactctgtctttagttaattcgctcatttttgcatagatgagagtagtgtgtttgatttgtaattgtgcctggagaaaggaaaaatttctaggaattgtggatctttcagttgacttgttcatacacagtaatatttactttagttatcacaaaatacagatttaatattttaacattaaccaaatgggatgatgaagtagaaaagatatttgcatatatgggaggaaaacccttgagttttcctcaagatttttttgcatgtaaaccttgcacccacggattgcattttcctccggacagatttgcagcaacatagtgtttgagagcgttgtcaatggacaaaaaatattacctttctaaaccattgtctctcagatgtatctttatatttgtacgtgcatactaaataaactataattcatatatcaatattgtaatagtgtgatactgacattatttcactggtatgtcctagaaattggtaaactcttatcgagaagtaacaaacagtaatgtgtctgtccgagcgggttcaatattcttatcttaattttctgcttttagcgtcatcatttggagtttgtttatcgacttctgtgtttcaaatgtacccatgttttttggtaatccatgttgggacagactttcttgaatcaagaccaggagaactcctaggtgctctctttgtagtctcaaatttcaaagactttttctaccctgtctttggagctttagttatttttgctcagatttcttagagcccatttgatggaatgctaataattaagaaatgtaattttcagggggtaaatacttctttgacatatattctgtgaaatatttcgctaatattcagaaatgggttctatttgtgctgttgcagtcaggtaggttttgtcaataccttgaatttggcaaggagatgtcaacctccagattaagtaatatgtcaagacatttttcccattacccaaaacatcaaaacagaaacataaacatgaaaagccatgactcactcctaaaaagaattctacaacatctgtttcaggctgctgtggagtgggactggattatgtaatttacctatctcaggatgacttttgggaagaatatgctctatgtaagaggaacaacatataaattctattttagattagatactaggaataatgctcttaaaattatttttatttttaaaatgtatataaaaagttattaagaaatttgcaaagaaatgggcttggttccattttctcaatctttcttttacccctctcaccaatatccatgaagatttctaagctacaattaatcatatcattgttaaatactatttattctttttcaccatactgtatattcttgcacattttaatttgtgtagaaaatctctccctagaaattctcccatttcttcagagtcttttctctattgcatcaccacaggcaggtctcttctttttcacacttattacattatagcttctggatcttgaatattaggtcaacttttttcataatttttcctgattttttcttatgtttttattctataaatattgtccaattcactatattctaaagtatattgagaaagtctcattgtaaaaggcaatgggtaacaaataccatccatgtgaacaattttgcattttctaaataaattgcctcaatttatttccatcatttttttcaagtgcctcaggcatcaatgaaaataggctcattaattgctaagtgagtaatttttctacaagtatagtcttgttttatacattcatttgtgcatttactgtgcgtgaccagattcaccaaacacaagcctagttaccaagtgaaatacacttttcctggaaaagtgggtattagggtcaaacgaaattcccacatgaatcatagcatcacttatgataattgctggaaaagcaaaatgctgacttatttacttgaatgggaaagcctagagtaatctacattgttagagaaagagtatgaggtggatataaaagcttttctcaataattcttggcacaggttgaacactttccctagataatttttcctggtccctcagtgaaaggtgatctttttgatttttcatagcataatatctttcgttctctctcatgtatatttcttgaattaaatttatttagatgcctgtcttatcttccctctacaatgtgagggtttttgttgttgttgttgttgttgttgttgttgttgttgttttgatggcatagactgcatttgatccatctccatagaacttacctggatcactcccttggacagagtaaatactcaataagtaaatacttgagtgcctgaataatttaatagttacattaaaaagtattcattgtagaaaggtaggtagagataaaactgaagaaagaggaacttcttcatgttggtttacttctttcccattctacttttatgcaaagcacaagtacctccattgattatttggatcttcattcattgaacgggagcgatgcatcagacacagaaggatgtgttctgccagttttgagctgcttagaattcatgtgttcagaattatgaaacagacccaaatatgttggcttatcttaggcaaaacacaatttcccagcttttaggaaaataaaggagtttggaaaactgagagacttgtaaaagactcagcagtctagtggttcttaaaagtttttattttgattgctgctgctactactgtacttcttactggcatttatagtaaattctgtatttgccttgtgcttcaaagtaatgtgtatgtgttgtggttgttatattctggggtcttgggcatttgtgatatgaataaatgaatgtgattcagttaacttcctgattgcttgttatgtggaagatccttcaaagtgtctatgttgtgtagagggagaaatatcaacaataaaattatggtctagtagagacaataggtatatttatagataatgttacaagggaattaaactattatctatcttgtgtgatacagatatttgtctattcaaaggcaaggagatgggccagaaattttgagtctgtttagattctgtggagctctgactttataaatttttaaacagaggaagacaaaagaagtttgaattctaattttgttttaaaatcatcatgtataggatgcaaaaggaagacataaacatttttggtaccataatgtaagaagggtaacttcctttacctatcttctcattatgccaaaaagttggaaccacttatttatgccaatttttagccgttcttgagggggtcttattgtacaccacaccatactagtaccattttaagttgtacacaatctcctaaacaataatctatgaaaatcatattggcagagtagaaaattttatcttgacacccaagaggtgtaagagagttttgagatgtcagctgttattgaatcagattctattgattgtacttgagtatcagcattaggtggttaaaaatgagtaagctactgacatacagcattagctctgtctattgctagtgctcactatgttttagaattcaagtgttttaccaatatttatagcatataacccacatagcccctataagagagactctacttttatctcattctgtagatgagaaccaggagcaaagagaggtcaaatgtgagtttaaggtcacccagtttataggtgctgctgaagttaggatctaacaattgcactctggctccagagtctgctcttaacctttgtggaataccattgtgtatttatgaacatgtgattaaatctgtggctaataaatgttacttcttagcatgagaaaatgattacaattcttccttatcttgatttttataaattaggaaaatagaggacttattagaataatatttggattcctattggtcgcttggaggtttcagccaatatcagaatgcttttcagtagtaataataagattggaatgatttctattttcttgctactatgccaagcagttaataagcattgactattttattttactatatatgtatgtgtgtgtgtgtgtatgtgtgtgtgtgtatatatatatatatatatatatatatatatatatatatatgatggagtctcactctgtcaccaggctggagtgcagtggcgcaatctcagctcactgcaacctcctccacccaggtccaagcaattttcctgcctcagcctcctgagtagctgggactacaggcacacgccaccatgcccagctaatttttgtatttttggtgggatggggtttcatcatgttggccagcatggtctcgaattcttgaccttgtgatccacctgcctcagactcccaaagtgctgggattacaggcgtaagcccctgtgcccaggctacagcattgactattttaatccacaacaacccttttaggtattagtctcatttttaagataaggaaagtgagacttagaaaggcaaaaacgtgctaatgaccatgaagacagtaagcagcagaaagaggctcaaaggcattggatccttaaatctgtacttctaagatctaagattagctcctttattatagtgattgtctctgtaaattaatatttaaagagcaaatcctaaatttatctttttatttatactcattaaaaataagatatcatacactttaaacatcattgtaaagactaatgatgccaagtgagaatatgaaacaactggaattttcataaacgttgggagtgtaaattagtacaagcattttggaaaactgtgtggtattatctactgaagttggaaaaacaattttcctatagcacagtagttttgcttctttgtatacatgccttaagtgagtgtacttacgtaccaaagatgtgtgcaataacatttatgtcagtattatacataataaccccaaactggaaaccactcaaatttttaaaatttcagtcagtgtcagaagaaataagataattttgttatattcatgaaagtaaaataacatatggcaataaaaatgaatgaggaaaatgtaataccatgttgaattattccacagtattaagccaaggaagccagacatagtaaataaatacatattgtaggagttcatttgtaaaaaattttaaaaataagccagaatgatctatgacttaatagtcaaaataatggtggtctaagagtggctccagagtgttacacatgaacaacttcttggcctgtgtggtagttacaggcatatattcccttgcaattatttaatgagttgtgcacctatgaattgtctacttcactgtctgtatttttacttcaataaaaagttaaatataataactattatttgtgagaaaggagatgttctggttaactaaatactcttgataatgagagtgttaatacgaatagctgccgcaagatataaaatccatacagttttgtaatggctttgtaatttttttctaaaatgaatgatttcgctttcttgtctctaaatacaaaacacaaaagtaatatagtgttactttaaagatttgaaatttttattttaaaaagatgataaaagtaaaatatgcacaatgtatgaaacattgagccaaacatgtatctttggtatgcatttgatttcctactattgtcttttctaaagtaggaggatatcaaatcactctggtaatttgtatttgattttgttgagattttatatgtgtcacataagaaattaggaataattttgaagtgtcaagtgtttcacaatttgtgccaagacttgacattttttgagacacctcgcccaatcccttagtacaatatctcatctttggcacttggccttagttgctagaacaatacaaattttatgtttctcaaataaatagttgatcactcaagatacatattcactcacatgataaatgccactgactcttcttccctagagcggagggtaccttcagtgaacttgggttgtctgaatgacaatggctttagtcacattggcacttggggccactcagcccccagtgcagtttcttctcatgacaggtcaagtttttgccctgctaagagccctattcttttaacttagttattcacagggagtgcagtataggaacacaagctctagattcaaagcattctaggtttaatttcaactctaccactgcctatatgctgaccttggaaaactaaattttaaagtggggataatatacttattgggttaaggtgcagatttgttgagataaggcatgtaaaattcctagtatagtagccgccatatagcaagctttaaatatcagttttcatttattaatcgctattattaaatacacctttctcttgtgtgaaacaaaggaccacattaacccagtttatccaagtggatccaataaagtccttaagacattactgattattcaaataaataaagctatatactttcttataacagagaactttatttacctagaaaatacagctttttaaaaagctgcctacagtgaatgtgtgacttggtatatgtttctaggtattcatatctaatataagtaaaaccagtttgaaaatcaatgatgtctcattagcactacatgccataaatgtgtgtgtgtttaaagagcttttagctgaaaaggaaaaaaggtcacctacgtatttgaaagactgcagccaaagattgaaggagatattttactattcttcattttatgtctaagctttgctaagatcaatgaattccaaatcatgcatcagttagtaggtgcagagaaaatgctttaatgtctggaaatttcatcaatctcatttctctgtcacaaaaggaattgcttaaatgagtgttcttgagaccaacatggtaaaattacatatcaggcatctaaatatatgtaaatatcaaaaaggtgtgcattttcaacaatatattctggttttcagagaattagttttgaaccagccactggtttcccaaaatatagctcaccattatcgaccagtacatcacagttgatgtactgcagtgtaacaaagaactgtcagctatgggatggtaaatacgatacatgcttcctgctgctttatcgtatatgcacattcttccccaaatagtttagcaaacgtttgcctcctacacacaaatcgcaagaatgccgacactctcaggagaccactaaaatccacagctgcattattttcctttctcttaaggggaaaagtttaaaaataaccaacttttttcagccatgtcttttccctaggaatcactttgttttcatattttctgcctctctgttaaaattgaaaacatgaatgcttcattgcctaagaaactgagtaaacttgctttctgaaatgtaccttttaatgtcttttatgattttgtttttcttcccttatttgcactctcagctgtggatgaatttccatgcaatgcatcatttctttaagagtttacacaccagaagaaataaaaatggaaaatggtatctattaagagaaaacagctttcccaagtccccagcagatgctgtcggtgagcagccctctgtttactcagcacagcagatcagcttaaccctccatagggttgccctaaagaaaggaacatatttctggttgttaaacaaatgaaggcacttttaacttgagtttaccatcctattgtttcagaatacagtgtggacctgggggtttgtaaatttaagccacatatcattccactttggctaataatatttctatttttttatatcccaccagcttctgtatgatcaattgcccatgatcaacttcagattttgtgcttccttccacacatcaaaacatatatgcccacgagagatgtcctttttaaaaatttttatttcaatagtttttggggaacagtggtgttttcttacatggataagttcctcactggtaatttctgagattttggtgcacctgtcacttgagcagtgtacactgtacccaatatatagtcagttatccctcacctccctcccactcttcccccgatcccaaagtccattatatcattcttatacctttgtgtcctcatagcttagttcccacttataagtgagaacatacaatatttggttttctattcctgagttacttcacttagaataatgatctccaactccatccaggttgctgcgaatgccattattttgtccttttttgtggctgaatagcattctatggtgtatatatgccaatttttttttttacccactaggtggttggtgggcattttggctggttccatatttttgcaattgcaaattgtgctgctctaaacataggtttgcaagcatcttttgcatataatggatgtcttttgtttttatacatttattctttttaacaaaaggctgtggttttctcttcatacttctcttcatagcataaggtatcatcagtgaatctttctgcattggaggcaattcaatggtttgtgaacaaaagtctttggcctgtcttcatctgggcaggagcatgacgatatgcagatatccatctgaacagatctgtgatgcaaaagaggggtagtgctaagtcttgtactaaacggtgcatgacttgatatacttaggtttttctctccccacctgaatctcatcttgaattgtaatctacataatcctcatcatctccatgtgtgaagggagagaccaggtgcaggtaattgaatcattggggtggtttctcccatgctgttctcgtgatagtgagtgagttctaacgagatctgaggttttataagtggttctttccctccgctcagcaattctccttcctgccatcttgtgaagaaggtgttttgcttcccttttatctcctgccatgattgtaagtttcctgaggcctccccagccatgctgaaatgtgagtcaattaaaactctttcctttataaattacccagtcttgggtatttccttatagcaatgtgaggacggaccgatagtacaactcatacaagcagtctcagaagggatgagacctgagaagtgtcagtggggcagaatatctgctttgtaatctaaacattatggggagggatgtgatcaagtgaatttgttaagtggcagcctgatgccccatttctctatgtctccgctattcatggcttgtaccatctctgtcaattgtgtatagacactgaaacattacatactactctgtaagctaagttccctacactgggtacttccaagcctatgaactcatttgctaaccaagaacaagagtcgcccacctcaaagtggttttagagatgaaatttatatcatactgaagaggagtcaggtggtttcagaatcactgtttggaccttgaaatagaaatgcttgttcataattaagagatttaaaagaagcagcagcagcagctgaagacgtttaaatcttctttcccagtcattcactatgaaatctaactccattcctggagcgaaaattgatggcatttaggactttagtgttttccaggtatcaataaatccctgctagtgtctctcagtttttctaatagccaggaggaccagtaataaagtacaataaaaggatttagtaaaagaagtaacatttcctcatatcattaagatacattttaggcattcttttaacatctgttatttgagtagcccatattttttacaattaatttttagccattttattatgaaatactacaaattaattaaacaaaatgaatagctccttgtttgttacaaatctgtcaccttttatcaccaacggtatcatgtaatcagacactggtaagatagcagaatacccctcacacctctaatcaatcattagtacatgtcccacctcactaataattgcttccttttgtttataatttcatcacctaatcatgtactgctaaacactagagttcagctttattatttttagggcttaatttaaatggaaccatacagcatgtattcttttaagtctagcttagtttgctacatgttatctttgtgaaattgtccataatgttgcatgtaactgtttattgtcattgatatataatatcccttcatatgattatagcacattaaaaatcatttataatgttgattaatgtttgggttgtggcctgttttgggttcttacaagcaatgcaatgattaaaattcttgtttatgtctcgtagtgcacaattgctcacatttctattcgttgtatatataaccaggagtgtaactgctgagtgaaagagtgtgcatatcttgaactttatttgatagaatcaaacagttatccaaagtgctatttctggaatttcacacccatcaacaatggatttctatgcttttatggatttgtttctggattttctgttccagtctgtttttctatttgtctatctcttcccaattactatggtttttctttttttttttttaaatgcttgcttttaaatttctttctttgttaaacagttccattcactgaaagaaaatagcatataatcaattcttaaagcatgcttagatctatcttttaaatgtgtttatgtaaacctgttataagaactaacgcaaaaagaaaagaaacttttaaatttgcagtagctataaaataaacagcaacatctggtatagtaagtccattagacatcttaaggagtgttgtggctatcttgtgccttggtattcccaaatatatttaggaattcacttgtcagtatataaacattcgcacagttattgagattttgattgagattgaatctataaatgagtagtagaatttatgtcgttacaatattaaatcttctgtcaataaacatgattcattattttgttgattagatcttattcctccataatgttttataattatctagaagaggtatacgtatctttttaatagattaattcctaattatttggtatttttaggatattataaatggcaccttttatattttacttctgaatacttttgctgatacatagaaatgcaattaatttttatatattgatgttgtataagcaactttattaaacccatgatttaggcagtaatttagttgtaaaattttcggttttttctttttttttgaaaacacataacatatttgcatattgagagttttatttttttccagttcttacacttttgatttgtttttgttcatgatggttccaatactttaaaattaaataaaatgcttatatgggttttttttataataacctttaattaaggagaaattttcattcacagtttgcaaaattttttttcattcattaattatttttgattgtggtaaaatacacatagcatgaaatgtattatcttaaggaattttaagtgtacaatttagtggcattaagtatattcattgttgtacaaccattgctaccgtccatctcaagaactcttttcttcttaacaaaactgacattctgtactgatcaaacaataacttttcattcacccctttttacaacccctgtcaaccaccccccttctttctgcctctgtgaatttaactactaatctatatacctcatataagttgaatcacacattatttgcccttttgtgtctattttatttcacttcacatgccctcaatgtccatccatgttgtagcatgtatcagaatttccttcaaggctgaaaaatattccattgtaggtgtgcatggcattttgtttatgcattcatcgttgatagacctttgagttgcttctaacttttggccattcattgtaaataatatttccttgaaaatgagtggaaaaatatctgttttcatgctttcaattatttcaggtctatatccagaagtggatctgcttctggtaatgggaattctctttatattgttttgagaaactgccacactgttttccagagaggtggcaacattttacattctcaacaaaatggtgcacaagggtttaaatttcttcacaaccttgcttctaagcaaggatgctttttaaaagttgagaattgaggttgaattttatcaaatggcttacagcctttattatggtgataatatgttatttcttttctttgttctatttatgtggtgaattacactgattgattttaaaaaagaatccactttgcattcctggaattaacacaaattgttcctgatattttggcctgtttatatattattggctagaatttccaatacttgtttaaaatttttgcatttatgtttatgaaagatttgtttatcaatttttctttctaattatttttggtatcagagtcatgctgtactcataaaataatttgggtaatcttttttattatttagtgggagactgtatgaaagattgatgtgacttcttccttaaatgtttggcagaatgtgctgcggaagccattaggcagatattttttgttgttgttgtataagctgattcttaattttagattaaatatattgttaaaatactgaactgttcatcttgtctgttttgttttgtgtttgttttattacgttgtccttttttcagcctttgtgcatttcatctagtttccaatttttagtatgtaatgtcccgttagggttattttaatattttgggatgtataatggtctccctttttgtattcttggtatttgtgtgtttttttttttacatttttcttcatcagtttccccatggtttatcaagtttattcgttttttttaaacaagcaattaaacaagtgtttgactatcctttctgttgtatttttctatttagttaatttctgtgcatttctttatcattttcttctttttactatctttgggattaattttgttccttttcttaagacgaatgtttagataattaatttttaaccttctctgtaaagatgtgcatttaaattacaaaaattctgtataaaatcagcatatacacatgtcgcaagttttgatatgtagaatgttaaaatgtagtttaataactatttttaaatttttattatgccttcttgaaccagtgtaccctaatgataatttttatcttttggcaattcattttctccctatgatttagatatccactcaatttcattacttctatatctctttctttaaaaaaaaatttagtaataggttttgctgagagaatacatttttaaactcaattatttctaaagcataaaaagaaaggattaaaaatttaaattttcctaacacctaccatattctgtattgtcttttatcatttattatctacctttcaacttctacctttatggatttctttctgtttgtgctttcttgtcacctacttcataagtttttgttcttgtctcaagataactttgatattgctctcttgtttcctaagacaatggccaaattctgtttgtagtctttatttacattttctttcttttttcaatttatatgataactctacaaaaaagatttacaggcagcttacaaaacagttatctatcttaccaagctataaacattggaaattttttgccctcatggcttttattttctcttgacttcctttttacctatataaatcttacttatcacacagattatataccatctgtattctgtatcataatttcctagcccttcatttgtgcctctatgttaactttctgcacactgtacattgttttattttagatgttcattctagaaatttcttgaggtgaagaattatattttatgtatcttttattccccagtgtctcataatagcaaccccattcaaaaacatacaaaatgcctaactaggacccaggaacacaaaggaagaaaaaggaaaaaatattgaaagtggagtttatagaaatccagatgtccatgtcaacttaattatttctaatatttgagccatgtttctctcatgtatatagcatgcttataaaacacctatgtgtgtgtgtagtcacatatgtattattaaaaggtataaatttatttttcctatctaggtacaaagttattcattcctacatatgtgctttgtgcaaatacatcattgtcttcagcatattaacctgcttaaggaaaagaaaataaacatttcagttgttcacataacttatatttcagagccaaatacagtacgttgctacacacaaggcactggtgaaattaactgtttccttcatttaccttctccaatatctacgtatccaatatctgtctatggatgctatggctagttaatccctttcaaacaagtattattcttgtcttcgtaacttttctctgtactgtaaacaaaaagaaccttcttttttgaataggttataaaaatattactgatttactaatttgataggacatccttccctggattatataactgttagttccaatatctgctatattaatgattatattgtgcttatgttttaataaatatgtatttccttcttagaagtctgtggctacaatgtagtgatatatgactacggtgtgattggaataaatagtcatagcaatcatctctttgtcacagtgtaggaaaaaaaaagaaggctattatggcctaacatggtcactcctcactgttacatatgaatcctccaattatctttcatatcagagtacttgaaaaaacagaagcctcaaaattatttttttataaaatttctatctttaagaaatgtattttcaatataacttaacatcgagtacatcttaaataagtgtaatagagaaactattgccaaacaatgaaaatagatggaagcatatgcattgtttgattatactaaccacacataaaaagtaaggtaaacaaaagactgatgctgaagggaaaaaaaaaatcctgctatcatttacattcggatgtttagtaaaatcacaacaaaacgggagcttttcaaacctagtctctgcaaagcacatagcttaaccgttagaaatgccaccaccaatgacaacaacaaacaaacaaaaactatgcagcaaaggaaaataatagtgagcttatgcctgatattatttataaagaaacattagtaatgctaaactcaagcttaccgacagtggcaagtagctgcacattctcagctgcactattacagctgttctctataaacctttggttgcaacattatggccagtagggcacagcatctagcagactgaaaggtcattgctttgtttatatgacttttataatctgaaatttcaacagaatgaatcccacagcaggctcaggtccctccagggccgcagtttttctgtggtattgtttgcctctagaagttctgtgagagagtgattagcatttggcaaatgttaactttgcttgagaggactttgtgtctgcaccaaggtataaactgaggagcctaaaggagaacactcacatgagccagcggctcctagaactaacatcaaaatggattaggtgcaagcttttttttttttttttcctaaaacctgtctcagtttttcacttgatttggtatattctagttgtcctctgtgtgagttcacctcaggtcctttgtctctatctcaagtactaatatcactcctataaatgcctatatttggaagttggagaggggcttaattcttcaaatagattgtagagtagtgacagtgggaacaggaagaatggaataattgtgggtggatatttaatttggccttgaaaaaatgccaagaatcatagctttgatattacccatatatctcttatgcaatagtaatgatggaatctagtaaggatattctccttcctagtgagaaattgcactgctcacagacaaattgaagtaagcagtgagtgggggctagggaggtgatgcgtggcatccttggaatgcaatgggagtccacaggtatcacaagggacagtcagatgaaacttatcaactacacttaaagaaaaatgaacctaacctttcattcatcaaacagaaccctatataaatgtcagtgagcatcagcattcaattaacattgtggcttattcatcagttagggatatatagtgtagggactcctgttgctcctgaatcataattgcagagccgtctcttcagctgtttttagctaggtgcagatgcttcacctgctgcatttcaagtacctttcaccaaatctctactttagacatttgtcatgtggtcccttagtaacacactggtaagatctcacattggttctttgtacattaaggttctaatgaagagttacccttctgggagcctggaataaattcccccacccacaagaaaaaaataaggacaaaaagagttgtttctttcttcttaatgtgtgcattgtttacataaaaacagttgttagaagggtaagaaacagttatattctcctgatatgtctgcattcaacccttccttggggtgtacttttaattctgcagccagggtattagcaatattaaactgaaaatgtcacaaaatgtcaaatctgaaaatgtcactgggaaaggggaaaaaagatggtgaccccatactatctacagatgaaataaatatgcctccctggtactgtacagtgattttttttagtggatataattttatacattttgcatcctattaattttcatggcatagatggagaaatattagaacagcgagagtgctgaagacaaattaactcatcaattacatgtatgggacagtggagactgagtttatttcaccatttcgaatagcaataaaactgtaattactaactcgtggaatcttcatggaaatctgcattcattactgcttaatttgaagtcagagactgctatatacttagcttttctaatatctgccacccagtgaaaacagtagaaaacagtttagaattaaagcagctgtcccactaagtctccacagaaacattttggtaatcatccaaactaaattttacccatgacaccagtgagactagtttgtacttaaatagtgcagaaaatggaaaatgaatatattgtttgttcaggggtacaattcccccttttttttactgttctctgcatgtcagtctaactctctgctaactcttccctcttctatcctctctttacatatgcaaacgcggtgcagagagttattttttaacagaatggctaaggggaaagatgtagtcagaagatttgggtacaaattctgtttataacacttaccaactttctttatggtgttgaacaagtcacttcacttctttgaatctcactctcctcatttataaaatggagattataatgtcaaccttctaaggtttatatgagcattaagtgagctaatgtatgtaaacacctctagtgtagcacccaatattttaatgttggtttcttttgttttaatctttaaaggaaaccaaaagttataggtattatatgttgtgttataatttatggagtgaactgaatttccctgacagcttagtatctagaaaaatcagaactgcatttattatacatatgccatttgttttgcttttgtatctttactatggttgaaaagcaaagtgttacatctatcgaaactgatcttttaactatacatttgtttttacatgccactgtgaattaattaaatctgaaaaggcatcatttaaatgcaattacttgtttttatttctttagtctgttactggcacctgggaaatgatagatcacagttttaaggggtcagataggggcagaaatcaacggcattttattttaggatcagtgatatttttcaaaagtttgtttctgtcaactacaggttttgatgtatgtgcatacagaagcaaaggaaacgtgtctgtggtatatgcactttctgattggagaacagaggcaataaagctcactctgatctgagcaagaaaaaggaacataaagaagggttgtggtagagattagttacaatgaaaaaatgcaaacagaataaatttttagaagtgtttgaaagttgtgatgggtgcttagctaatagttcgaaaactccacctgcatcagtgttaggtatatttattaataaatctcatactctatctctctgagttcctttgccttgtagagatttgtaaaacctaacaacactcaataacacaattaactgtaaagaggttagaacaaaactaaattctatgcgttttcttcattcacttgcctattttgaggtatttttccatttccttaaaagatacaaatgtttctcctgaatcaagcaagactggaaaagtgaatttgatgacttgatgtggctgatctggccacatgtatgctccatgggtttcaactgactaacatagaaacagcacaacatttgtattgctagccagaaactgttgagcaaatgccgtacctctgatctcaaactgcttggctgaatctactgaacagatccaaagtagtatagaaaaaaaatctaagtcagggatttgatgatctttcagactctttcagataataattgttatctgcaaaattaagatttcaataagttattacacgcagatctctgctaagagctcctgctatatataatatgctcttaagtaatgttagctcttatgattcctactcaagttacagtttgtatagtaaaattagggtacaaatgtcaactagagagtgatgtttctacgtacaaaaaacaaaggaaagataaattcagctgtatatgatatctgattgaaaagcccaagcaagaaagctaatgctctaagcttagtaacttagaattgattagccacagtctgctagttgataggcccagtacatgacgttgctcagaaaatgtagtatttagaaagtatctagtgaaaataatttggcagtgtcatttataaattgatgtctgttcactcacctgattaaaatgtacattttcaataaacctcaaaatagaaaatactatacagaaaagaccatcttgagtgtaattttcttaattccaagaatctgtcaaagaacataaacctgctgattctagtgattagaagtggttcacagaggtttattgtgcaacatttacattttatacctaccttgatgtaagctgttcctgttatcgtttgtcataccatctctggccccttctcaattcttctcctctgtatatactctgaactgtgcaaatatgatgcaagaaagtaggataattgatggtaagaatttcttttaagaaatgaccattttagtgcattgtgagtgaatgagagtgatggctttgcatttttccagaaatatacagctatttctggaatagctgtctgacctgtgttttagttgactttggagtatattgttaggacgtaaaccctgtggtggcatataggaaaatattgacagcacctatttttaagtattgtaaatgcatgtaagaaccttaggctctcaaattatcatatacatatatatatatatgtatatatatataaatcaattatctctcacttgaatttggaggagtttcttggcttttcagggactatgcttaagccatacttaactagctcaaattctctttctatgcctgctctttctcactttcaggtttttgcacgtgctaccctctctgcctggaatattcttctctctgcttcacttgtcttgtctgattcactccttaaccttttgctttcagcctagatattttgtacatgagaaaagtcttctctgaccaacaaaagtaggctaatacctttacccatatgcatccaaaacactccgatcacctctaccattgaacatgttacattgtactgagcatttgtcattgtgtgtcagtgtcgttcacaatactagaattaaactatagataacaactgtattgttcaccattttgtcttgagtttttagcaaagcatatgacatatattagatgtttagtaaacattcattaagtggactcgtgatttagagttggaatgagttgggctaacagactattcttgcccaagttttcttctctgggttcagatgtgtctccgaatcctggaccctggtaatactttgctgtgttccatgccgggatctagatctgggattccttaatgcaactattaaagttcttacttaaaagcaatctgtgaggtatgtcctcttttaggacctctgaccaaaatccaaagatggagcgaggacactgtaatttccaagacccttgtaaatatagaaaaacattggaatttccactataggccagtgttcaccgttgtcctctagactgttagtcatccagcatttagaaaaatactattaatgattgataacctacctctgggtaggcaattgaggttataaagaacttctcaagctgggtgtggtggctcacgcctgtaatcccagcactttggaaggcctaggtgggtggatcacttgagatcaggagttcaagaccagcctggccaacatggtgaaaccctctctctactaaaaatacaaaaataagtcgggtgttgtggcaggtgcttatagtcccatttactcaggaggctgaggcaggaaaatggcgtgaacccaggaggcgaagcttgcagtgagccgagatcacaccactgcactccagcctgggcacagagtgagattccgcctcaaaaataaaataaataaataaataaataaataaataaataaataaacaaaccatctctactaagaatacaaaaaattagccaggcatggtggcgagcccctgtcatcccagctacttgggaggctgaggcaggagaattgctggaacccgggaggcagaggttgcagtgagccgatattgccccatttcactccagtttgggcaacaagagtgaaataccgtctcaaaacaacaacaacaacaaacaacaacaacaacaaagtttctacaatgcgatgagaataatggccaccaaatgcccatcaagaatttcaagaatttaatgtctttactagtggtattccataatcatttaaggattatccatagttaaaatttatctgtctccatctattgccattgtaaacagtggaaactcacagctatgcacttgcatctgtcacagacatgctatttatttcttgtcctgtcaacttcacctatttttatttgctaaccatattattctcatatatctaacacattagaatggatgctcgtttgtgtacatcatcactgaacatatagaatgttgtatatagtcaaaagcattttcctaatgtagacttatgaggaaaccaatccatcttacccttctagtgtgtcctactaattctatacaggagattaggcagtcagctattattctcttattgcacagaatttagattccacatatcgttctgttggatacaaccgtttgtctttgcaataaaatccccacaaatattttatggtctgaattcaatagtgttaagagctttcaatttctgaagtcttgccctgttccttcttaaacacaataatcaataagccctgtgtcacaaagtcacatgttttaatggaattacattgataactcttgccaaagtcttcctttaaaacctgaaattctgtgataaattcatgtgtgccagtaatggtcataatctttgagtactgtctttctacagtctctattatattgccacttatgccataccttttaaaaattattttatatagagtttcaaaggtaaaacttttatatcttttccgaattagtacttttttttgcacaaaaaattagagaaagattttcacttataattttgagacaaagtcctagtttcctagcaaaattgatgtaaaattatttgttcttgtgcttctgctattccacctcctcctttttttgtcggtcctttgtttaggaaatattttaataggtttatgcatgagccataagtaactgccccacaatattctttatataaccaatattcttttatatataactcttatataatcaatattcttttatatataacactttgatgtataacttcttgatcctttgagtagattattttatactgtcataagattagcatttttttttctgtgacagtgctcaagtttggactagttggtagaagttttgagaaataacagaaatttaaataaccacgtctataatttactgagtgcttatattctagacactccagtgttaagtacttttcatatattaatatattttaatcttcacagccacgcaaatttgcctcccactttatagatgaagaacttagaattcagagaacttaaatagactgccaaaggatagcaataacaaaagagactattttggaattctgcggaatggaaaaatgaacctgaaaatctaaaccatagaaacaaagcaaaagtcctagagaggactcttagtcaccagtgaattctcttctcctggatttttgcttacaccaagcatttcttcctcttctttgttggctattcctcctctgcacattctttaatggttggcttcttctagggttcagtcccagatcttcatttctgttcagtcttgttcattaggagctttcatccatcacatggttttaaatactatttaaatgatgataaacctgaactgtgtatcagtagcccagagctttcccatgagttccagactcatagtcagcattcaacctgatatctccactaacaagcatataaaattgtatgggtccaaaatgagtgctaaacttttacctccctgaaactatccctctcgctgtttctcatatcggtagtatcactacaattactcattaatcaaatcaaaattatatgaagcatccttgctcattctttttccctaactctcccagtaaaacataaattctatggattctatctctagcatatgtcttgaatctgcctatttgtattgatacttctatgattatcttttcttttgcccttgccctttcctaactgcagaccttaccctggaatgctgtgttctccttgatcttatttttttttgctagattcttctctctgagttctcaacgtgaaagtagacagaattttttcaggacttctttagtcatcttatatagtcccttgctctcttccaatcccatccattcttgtctcaccaacctaaatgcttatatttctacttgtcattatttgtagtattttgataatcctttgtatacttgcttgctagacaggctcacacaaaggcagagatgtgtttctctgttgtatccccagttaacagcagagtatttggaaattgtaagtattcaatatttattgagtttcaaaaaaactcaataaataaagcctaatataacggttgcaaggatgaggtgggtggtgaggtatcattacatgggaatgaggcacttcagtttcgtttgataaactcctcctttttaaaaaaattgactgtaccctgtggaattcctgaagtgagacttagaagattcttgacactggctatttcaacttttttttttttttttttttttagtaaaaacatactaaatctttattgtccagccaaatcctcttttctgcatttaatgttaatctcttcttaaattttgagttcagaaaagcctactttacgttccatgatcatcattgcctttttatgaatagaagtttataggttgcattcatctctctcttcgttacaaattaactgccacaatgatttatatagaataagaagccttattattactactaattgtggtacatggtggatggtgaatgtatttttagctaacctttattagtactttgctaaatattttacattcttcctcttgtaattaatgctatacctcttttacaaagaagaaatattaaattacaaagcttggaatggccaaactgcaactcaagcctaccagaagaaaatgatcttaaatattatgttctaactacccagtacttcctgtctatgccttctcaccaggagtgcctcgtatctcatcatacaaacgggtaggaatgatatcacaatgagagatgaaagaagaatgtaaatttcttttgcataaaggtggaatactcacaattcctcaccaaagcgatgtgattttacattctagtatttgctttattgaccaattgtaccttcatgttagcatgacaaaaacttgaaattaaattcatctttaaaccattttacttgtattttggctaaataataatatttgaggagtctgtaagtttaaaaggggagacatctaaatggattgcccttgctattaagcaggtttttcaaagttagtcctcagaccattttgctggtgtagggcaaattcccccttccctttgcagtcagactagatcaaaatttctggttcacccaatttttacagcaaatgtctacaagcttacccattcacaagtactttaataataacctaaagaataattttgtcttgtacatttataaaggtgatgtgagaatttattaaaaagagatcccacactatggaacaaatatattattaaatatatattatttagataattggttaagcataagtatgtatgcaggaaggaaaaagaatgtgtgtttaatgttagccaccaggtcatggtgacagtaatttagagaaaagtggcagtggtagctctgtaatatatatttttgaattttcattattaatttttctttatcttttttttttttttttttgagacagcgtcttgctctgttaaccaggctggaatgcagtggcaaaactatggctctcttcatcttcagcctccacctcctattcttaatcaatcctcctgcctcagacggaactataggcatgtaccattgcgtccagctagttgttttgtatttcttttgtagagatggagttgtactgtgtttcccaggcttgattcgaactcctaggctcaagccatcttcccacctcagcctcccaaagtggtaggattacaggtgtgaatcactgtgtgcagctttgcataattccttgatgcactttttttttttttttttttaatttgagatggagtcttgctctatcacccaggctggagtgcagtggcatgatctcagctcactgcaatctccaatttcctggttcaagcaattaccctgcctcagcctcctgagtagctgggattacaggcactgccaccatacctagctaatttttttgtatttttagtagacatggggtttcaccatgttggccagactggtctcaaactcctgacctcaggcagtccacctgcctcagcctcccaaagtgctgggattacaggtgtgagccaccatgcctggcctatgcactccttaaacccctattggtcttcacaaattcctactgaattgttgtttaattcatttattcatccaacaaatatttaatctagttcttcactcagctaagtgttggtcaatattttgtatcagacataaagtgctattaaagagagtcattctgcctgtttgcaattgtcaaatatttaatttttgaagcccacaggtttgtcatttgccacacacggtttcatcttctgagtttgtttttccctggctgtttctctttcaatttgctagtgtatatagttgttttcatactggagctgctaaaatcttggctcttttcaaatgcaaagatgccctgtatttgcatttggagaatgtttgcaaagaattttcttcaggatacgtctttacaaaggacctactgtagttgtgttataaggaattttatagcaattcctgatttttaggtataagaagtattatatcccaactggtacgtttccttgtagataactactcattttatagaacggtttacttttgagatgtttttcttactactgtcaaaataaaataatgatgacttcttttgaaatttgaaatttttttgttaatgttttagtctctagtgcctagcatgtagtaggcactcaaaaatattagttgtgtggtaggatgaataaattagcaaaaaaaaatcccccaatctgcagcaaaaactcttttataacacaattctgcatctccaaagctttgttaattatcacatgtgttttgacaaagaaatggaccagatagaatattttatgctttcaactagagtttcaaaaagtgactatgccatgtaatacaaaagagtagatagtatccttaaaatacgcacatggaactcttccaaatgcagacccttggagtattttcaaatctccttcttactgtatgtttacattctaaaaaaaaaaaaaaaaatcctatgacttttctcaaaaatgaatggccacctctctaacctttaacatggttggaattgattgttcctaatctttatggatatctcctttagttttgtttttatagtttttctagaatcccagtgccctgccgcaattatttctgcaggccctttctgctcttgaccctttctatttctattattttttatcattttctttagtcatatcatatacttcctctgcacctggatcttctcttgtccttgaacctgggctaaagagaacactgtaaatgctaatgaattcagagttgtctctctgtctttccttgaatctttccccttgctttctccctgctggcactctgcctctgtctgagtagtttacattcctggaggtcaaacttctttgactttggctgctcctttatttggggtcggacaacagtgatcatttctatagatttccttcctctgtttccatctataaacactactcgagcttctcttacatacagcattctcttacctctgagatttagactttggcatctgaaagtctatagacattatctctcttcatttcacagatgaagaaagagttgaagtttctggttaaatttggtgcattgaaagcatgccattcctccagaaacctgactaaaataatagaaaaaaataaaagagctaaaaatctacaggaacaatcagtagtgaagacaacagcagctgagaaatgacacaaaacttcagatgaaagcagatgggtgagtaatgagtgaattggcagagcagagtggaaccctgggtgcctatagagaaggacaccagagaggagaaggtcactttgtcccccctgggccttggaaagtccctcaggctctaaggaattacaggaatcagattccgtgaaaggcaaaatttggaggataaaaaaattagaattggtttatttttgtaaaagaagcgattagaaatgtcagatgccttttcccacttctcacagcaagacaactacttccttctcaaacctgaaagagaaattaaatccatttttcagataaactgacctggaagagactttgaactgggattccaggcaaagcagaggtgagattagcttttttcgtaaaagccaggagcttccccaaatgtctgcatagctaatggtaagaatacccatcttttaactttgtctcctataatggtaaattattattgtcagaatcagacatctgtgagtctccctataaaaatctagctagggactccattaagttacagggtagcatatgaattcatgaacccagcccatgtacaaaattcaagatcaatttttaaattactcactctgagtgaataaagaccactagaaatctgggtaaaaattacaacgtgggaaatagagacaaaaacaaaaagaagctcagtgaaaatagtccacactatgaaagggagaaagcatcataaagccatgattaatattctcagggagataagggaaaatgtcgcgctcatcaaacagaaacagtatgctattaatcaaagaaattctcggggaataaggaggattcatttgaaattgaaaatataatagttaaaaaatcaaagtgttaaaaagttaatgtaatcttctagactgtagaacaaagagacaaagagatgaagttcagtactcaactaataagagtttcagaaagagaaaaagaaggaaaaaaaatcaagtgatgccaacatcaaagaaatgagaagaatttttcaggaagtgggagttagaagttcctataatgaaagagcccgccaagctctcagaaaaatgggtgataaaaacccacttcaaggcaacataacatggtcaaatgtcaaaactaatgagtttttgatgttttcagagttaaaaatgtggttacacatgatggatcatgctacagagcatgtagatcatgatatggatcatgatgtaagcacagaacttccctacagcaatactggaagctagaagattgttcttcaaaatttggaataaaacattttccgtgaatagttctatatgcagccaaactttcaactaatttgaggacagaataaagacatttgcagacatacgtgatgataaacagttactttccatgcaccccttcttagaaagctactatcacaaaatattagtggcataacatcatcttctaccacctgtatttgaaagaataactgcttattgaaatcagagggttggtttacagattacttattttaaaagtccaggatacctcatatttaataaatactgggtgttaatagtgctgagttacttgtcagttcaaattgttaattcgccagccagcaagaccctgagaattcagcctcttacctctgtcagaattgcacttaaatgttctagacatattaaaatctgctttttacaagaaaattccttcttccctgtatgacccattctaacacttaacaatttcccactgctaagaatttctttgttatgtctcagttaaatctcttaaattgctacttaagtgcatttattattttttccattttggtgctttgttatggataccaactaaccaatgcctgcatgtgtgtgcgctctctctgtctctctgcctgtctgtttctctctccctttctaatcaagcttgcttcaaattcaaagtgaaaatttttcgtttgttttttttctttttttaattttattttattattattatactttaagttttagggtacatgtgcacaatgtgcaggttagttacatatgtatacatgtgccatgctggtgtgctgctgttttgacatggtatctttaaaacaaaatgaaggagactatactctgaaagctaatttagggcaactcatggctttcaccaattgtagtcctctgatgcataattctgtagcataatgtttctctgaataatgtaaatatgaagagaatttggctatttactgacctttggaagtcttactaatttaatttagctttctatcccttggaatgaactaccttcctggaacttcctattctgttgtcattgccatgtctatgggactatattgttaaccactcactcagtcaaactgagtttaatgttaaatgattttaatattcactgttgatttattttctctcctatgtaagtagaaacaaaagcatatatagaaagacttaaaagacctgatttcctgaaaaaaaaatggttaacttttgaacacaggttcttgtagaaaatattattaacataaaatttaaatatatagtaaaatacatacttatattacacaaatattaaataactttctataatacaagcaatttatgaagcatagataatgtgtatttaccctttatattaaataatgaaacatttttgttaatgtgttagccttcaaggataactttcctgctagcagtagctgataatgatgctactgagaagacatcttcaagagagatttatactctaagtagatcacagacaaatcaatgcataaaatgtaaataggctgcgtgttgtatcattggtgatttctgcttttatttagaccatttaggtgactacctttaaagtctttggcagtgtgtgggtggtcaaagaatttctaagctactccctcttgctttcagatcattgaaccaatttagctctagttaataactctattaactggataatggttactgtccttttatcagctcagtaacactacatccccattataaacaactggtcagtaacataaatctctttatatagtaatacacaaaatgctttgtctcttaagggcagtctcacagacagtaactagcactatatttttcattgggaaaagctgcctcaggctcctgtggggctgcaactgggtagcatcttctaatctcttctccagagttgaacagatggcagctccctgattggaaacttgattcaatgctgcatttagtgtgattaaaacaaatggtgagcctggagctgggtgtatacaccccacagaacaggtggcaaaatggaaagtgaaggtaacctgtttatttgtctacacaacactaaagaaatggcttgatgagtattctccttactagtgtgaatctttttttttttccttcatcaaatgaattgaattgaccagctgtattggtgtcctgtagacacagcctgaaaagtctcctgctctaacaggcttcaagctagtaggggtctgtagtgacgcagcaggtgcagagagatctaagcccttgaatgtaatgtatacacagagctctgcagacagccccatggagctaccacataagatggtttttcatgtgtaaatgagaaggtcttttcatttttcaagctattgcattatatccccttctgctgaaagacaaatacaggaaatcaaccaacactgagttaattacagagtgaccagttctataatcaggattgcagatttcagtcttgaggtttaagtgcacaagcatattttgcactttggtactcatagttcaagccatcttgggaagtcatggttttcatgattttgctccctaggacatcagtgctgggagcctattggctttgaatgaaatgactaccagaatgggggttgaaaacaggaaatacttttagggtgaagaattacgaagagctcaatggctgatttacaatgtgagaaattacttggagtggtgttttaatagaaatttatttccttgaaagttgctgctagaaagcgatgttgaagtcttctagaatgaatagaagaaaataagcgaggataagatatatctttaatgattctcagtgatgtttcttaattgtggaatgaaaaactctatttaaaattattgtaaaaaaacaagtctttttctactttcaatattttggctgtgtaatttagctgttgaaagagtaattgtgatttttacttacgtatcagtaattttttaatatatttgatattcctggtcctattatataatggaatcctaaaatatttaaaaaagaagttgtcatgctacttgcttatgtacatgcttatgtatgtatgagtatagatgcatacacatatatctttttgctgtgtatgtatgtatctatatatacatatatgtatagacacacacacatatatatacacatatgcaaaacacgctatgtactattccctccgaaacattcaacaatttatttctaaggtgttaaatgaagacttaataatgaatgctaatacctttcctatatgaaggatttttcatgatagacattgaaatatgaaattttgatggtactattattcccattttataagtgaaaaagctgactcagtaaggtttggtaatttcccaaggtcacacagctcatacattacagggtcaggaattttaacttcggtcttaaatcttttaatctgacatgtaccttttcttgttaacatatatgttaatataaaagcttcaagtacattgcaatatgtagtaaagtgaatattacatatacatgtgctaaaaatttgcatgtttaacatttcttgaatgaatatgttttttctggcatacatctaatgtaggaatagttaattacaatccagtttttgtaaacaaggtagagatcatgtatatctttgtttcctttagtgacatacgtcgcctaaagttgttcttccatatatggatcgcatttatgggttttttttttgtaagcttagcctcaaaagattaatatcagaaacataattttaatgccaggtttttgttttcttattattgttagtagcttctgaaaatagaatttatctcttttccatatagtaccttcatatgatgtagctctctgtaatgacaggtggcattttttttgtatgtttgtttgaacaaaagctcaagaaaaatctgaaacagaaatatttaatatttatatactcaaagaaggcatcaaggacaagccttaaagactctttggcaaaagctcattactaagctccatgtagccagaaacttacatgatttgggaacttaatgtttatagaagtactgacagaactgtgccaaatgttctggataatgtgtcttgggagagatcaggtgggttcagattctactactccatgtattttgcaataagactggattccagcccttgacttcctgagtacaaaggagaaaaaggaaagggtatcagttattccatagcggacaacttcggcacaatcctgttggcttttccacaagtgtctgctattggtcagctctgtcattgacagctgggggatcgatgcctgcagaacagccactaatgctaatggagctacacatgttaaatcccactgccctgacaaaggacagattctggtgttgaatgtgagacttctgtgaaaagcaagatgggactgatctcactaaaataactcttccttcttgcaaatctatagctttttacaagacaaattgagctttttttctctctggtatttgctgggaaaggaaaaatggaggaaaaatataactgttcttcttggtggtgctttaccagtatgactagttttagaaaatgcagtttttaaaatacagaaatattcttcgaatagttctagtcattgtctctgcataatctcatttattcaggtaaaaatgatggagccaataagttctccagatgtttctattaataaatatttcgctattccagatcctataaaaaaggaaacaggatgactagagttttttcaatcttttcttctgaaattataaattcttttcatgatttgaatgtggatactgatagggagttatacattttaactgtgaggtttggattatttaacaacttctcctaagtattatcattgctcttggctttattctacttgatactacaatgattccttagtagaattttctcactttagaggaaacattgagttgataaaggaatttctttcttatagagaaaaagattgggttcgttttctcctatttcatgaaagtgttcattaatgtctagatgtctattgaatgcctacttttactgtccatcagatgtacatctggggactgggactcgccttttattgtgggaagacataaattgaaccaaattattgcataacatgtctagtgataagtgccaggaaggaataccaagcagcacagtggagacagacttgtgggtaagagggctgctattttatatgtggtgatgagagcttagatggtgttagaggtaaggagcttgatgctaaatgtttgctattggcttatttggaaagccagacctagaggaatatcaaaatgggtaacctctattcgttttagagcacgacattttacaaagtggcataatcggacatttttctctctctaatatggcataattttgagcgacggagccttgagcaaagaaatctgtcaccagttccttgtcacatcagttacaggccacaattgggaatattgagattcagaatatttcacagcattaaagaaagcctggaagaattttgccatcactttattgagctcaggaacaatattgacttcagagtccttgagatacttcaatctctacttctttgcctgttccctatgctttcttctcctcctctccaccccccaccccttactctccaaggtggatgcagtcatcagtctgcagaattcatcatggcatgcttctcttcgagttaaaacctgaaatctgtcaagtcacagtgtcgattattgttttgaattctatgcctaattgtggaactaccaaattagcattctgcacattttttccaagggttttctttagtttccctaccaccaaaccctagggttgcttgctgtatctacctataaagaaatacacagtcttccatacaaatagttaaaagttttgtggtaatttaatcttcagttggaacatgctaggtggtcttgcaccagttgcttgtacttggtgaataggcaggcgtggagctaaagccttcaaaaaggtaaggaagaagtctaaggacatgtatatgtgcatcagcaattattttttaagccagattgaaaactcttacgagaggtaatacttcccttagttccctgatgaagcaattgaggctcatttggccagtctgcctctcaatgcagggttctgaaagattatctgagttactaaaattcaaacatcaaacacataattttacctttttgtgtttttagtgtgtatgtgtagggggtagggtagtgtagctgtaggtatgtgtgtcattattatataacagatttcactggcttttgcagtaatatctctcttaatacattataatatccttcaattctattttaagttctcattgaactgataggattttgctattttaatgatgtttactaaaatcgataaaatgctgaatagttttttaaaaaagctttgtgcaacaacaaataaaatttatttcgtactatctattaatcttaatcttgtagtagatttatcatacatttaaattcttcacatgcttgctaagattaccagaaaaaaaataacaaattgtagctgagcagatgaggaacgcatttatcattgcattcttctcatattttactcagaacttacacaatgattattactgtccatacatttaaaatatgatagtaaaatatgtaataattacaccatatcctaggccgtaggctaaaagctttgtgttccttatctcatttcctcctcattgcactcctgtgaggaagattctatgataatgcctattagagagaaaataaacacatggttgatcaggttggaaaacttgcccaaagttacataaccagaggtgggcttaagattaggcaggtgacttgagaacagacaccaaacttatgccatttctagagactagtggagaaaacatgaaattcagaattggcagttcctcattttaacagcattataattttagatattgttatttgactcacaaaacaggaatattaagaaaaaaatagacaaatatgtgcaaaagtgccttgaaaatgttcatactagctaaatagatatagtttcatttattatttccttaaaaaacaatttcttgccaagcttttttgttggacacagtaggctataatttaaaaagtaaatgagaaacagataaagttatttaaaaatttttaaaaatcaatgcattgctttttaaaagtagcattgaaaatttcacagctttaatgcaaggacctttatgttataattttcatctaacacaggtatatgtaggaatgcaagagacttgatcttaaaaaataatgtagaatatcataaatatttatcatatggggcaaatatattttctttcttagagctttcaataggttaatatgatgtgaaaaacagcaaagaaattttagccaaactttggaagaacagcaatgactgaaacacctctattcatattttaataaaaatacctattaaactattagaacgtaaacattttaaatagctgtccctgaaaaccgagagtccactgaaaaaatataagaatttatgtaaaattccagcaaaatggcaaatttaaacattgttggtttatataatcagatggaaactgtcttaagaaacttattgtattcaaattagcaataaaatacataaaaatgctcagaaatatactaaataaaaaagaagtaaaacgttgcatgtgatatgaaacttgactttctggatcagtggagaaacagacaagtcactgatattaagtattataaatacaatgatcataagccagttggagaagactaatgaaatcaccatagtattttggtatttttcactgggttccctactcttgtatgttgttgtagcttaactttttaaaaaacagctttcttagtgtataattgatatgaataaattggcatgtttaatatgtacaattttgttttccaatatataccaataatgctatcactggagtcaggataaacacatttatccctaaaagtttccccatgccttttgtaatactagcaaccattcccttcttgactgcttctactttcttaagcaccttctcatttgttttctgtcactgtagattagttttccttttctagaattttatttaaatggaatcatacactatgaactcttttttgatatggcttttgccaagcacggtggctcacacctataatcccagcagttttggaggccaaggtgagtggataacttgaagtcaggagtttgagaccagcctggccaatatggtgaaaccccgtttgtactaaaaatacaaaaattagctgggcatgaaggtgttctcctgtagtcccagctactcgggaggctaaggcaggagaatcacttgaacctaggaagcagaggttgtagtgagccaagatcatgctgttgcactccaacctgggtgtcacagtgagattctatctcaagaaaaagaagaatatagctcttatcactattcataattgagattaatctatattgtgtatataaacagtcatttttaaaattgttgatttgtattccattgtggaaatatgccacaatttgtttatccagttacctaatggccactggattgtttccagttcttggctattacaaataaacatcaatgaacatttgtgtataagaagttaaggcatgaatcggatatactcctccctaggtggtaagttatatggtttggctgtgttcccacccaaatctcatcttgaattgaggttcccataatccacacatatcatgggagggacctggtgaaaggtaatttaatcatgggggtgattatccccatgctgctcttctcatgatagtgagtgaattctcatgagatctgatggttttataaagggcttttttcccttttgctcaacacttcttcctgccattatgtaaagaacgacaagtttgcttccacttctgccatgagtgtaagtttcctgaggcctcccgagccatgtgaaactgtgagtcaattaaacctctttcctttataaataacccagctttgggcagcataagaatagactaacacagtaaattggtagtgcagagagtagggagctgctgtaaagatttccaaaaatatggaattgactttggaacaagataacaggaagaggttggaacagtttggagggctcaaaagaagataggaaaatgtgggaaagtttggaacttcctagagacttgttgaatgactgtgaccaaaatgctgacagtgatatggatagtgaagtccaggctgaggtggtctcagatggagatgaagaaattgttgggaactgaagtaaaggtcactcttgctatgcaaagagactggtggcattttgtccctgccctagagttctgtggaactttaaacttgagagagacgatttagggtatctggcaggagaaatttctaagcagcacagtattcaaaaggaagcagagcataaaaatttgaaaaatttgaaaaatttgcagccttatgatgcggtagaaaagaaaaaactcattttcaagggagaaatgcaagctggctacagaaatttacataagtaaccaggagtcaaatgctaatcagcaagacaatggggaaaatgtctccagtgcatgtcagagaccttataggcacctcctcccatcacaggctcagagacttattggggaaaattggtttccttggcttggtcagggactttctgctgtgtgcatcctcagacttggtgccctgcatcccagcagcttcagctccagccatggctaagaggggcgaaggtacagctcgggccattgcttgtcagggtgcaggccccaaaccttgtcagcatacatgtagtgttggccctgtgggtgcacagaagtcaagaactgaggtttgggaacttccacctagatttcagagagtgtatggaaatgcctacatgtccaggcagaagtttgctgtgggggtggagccctcatggcgaacctctgctagggcagtgtagaagggaaatgtggggttggagcccccacacagagtcttcactggggcactgcctagtggagctgtgagaagagggccattgtcgtccaggctccaaaatggtagattcactaacagcttgtactttgcgcttggagaagttgtagacactaaacgccaggccatgaaagcagctgggaggaggactgtatgctgcaaagccacaggggtggagctgcgtacagccatgagaactcacttcttgcatcaatgtgccctggatgtgagacatggagtcaaagaaaatcattttggaactttaaagtttaatgactgccctattgtattacagacttgcatggggcctgtagtcccttgttttgtccaatttctccaatttagaatgagtgtgtttacctaacacctgttccctcattttatctaggaagtaactaacttgttttcagttttacaagcttataggcagaagggacttgtcttgtctcagatgaacctttggacttggacttttgagttaatgctggaatgagttaagactttgatggattattggaaaggcatgattgtgctatgaaatgtgaggacatgagattttggaggggccaggtgtgtgacgatacggtttggctttggctaatcatgaattttagtgcccataatccccatatgtcatgaaagggacctagtgggaggtaattgaatcatgagggcagaataccgccatgctactcttctcatgatagtgagtgagttatgagatctgatggtttcataaggggcttttccacttttgcttgacacttcttcctgccattatgtgaagaaggacgtgtttgtttccccttctgcaatgattgtaagtgtcctgaggtctccctagccatgcagaagtgtcaatcaataaatgtcttttgtttgtaaattacccagtcttgggcagtcctttatagcagtgtgagaatggactaatacagtaagcattatattgatgatgatgataataatggtaactgtcattaagtaagcttttgctgtatcagactgtatcacattctatgtgttaaatgtattttatatgtgtaattgtaacaagataaatttaaagttcagctcagtcactgagacaacaaaattgtcagatccttaaaagtgtgtgcatatcttggaatgggatatcatgaaatgggatatatgagaatggctttcatggctcttgcgtagagttttctgtgaatgaagcattgatagcacaccattgtttcatcttgaaacgtagagagcttcaactggacttactagaaggcttgctatgcattctttgcagttgaggaaccctgctgtgattcctgaatgtaccactgaaaactaaagctgaatttggtgaagaaagatgtgaaagtaggaagctgcactcaagaagtaaacacacttacactgaatgcaatacatagtaatttgaacaggagtttaatctagttaatggggaccctatggagggtcagaggactccaatagccagtgtgagttgtagacaactagagaactagggctgaggatggaggagtggccaggaggctgcagtgctagaggctgagcaagagactactgtggagctcccggaagtcgcataaacatcttcctcacccagagaacaagcaagtactttcctgtcctggcatctctttcttgtactctttgaccttggtgagatttaaacagtggcagataatttgaggaaaaggtgaaaaagctgagcagagaaagagagtaggagtttattacatccgctccctgaagaccagcaggttaccaagtacaggatttgctccagaggaagaaaataagagcaaagggattaaagtgatgaattaataactttgatgggatgtagcaaattactgaatcaagacagggctttgtaacataaagttattgtataactatttattatcaaaatgtaaagggaattgcttttctcactagatagtttttgcttcccaatgtccatttaaaatttaagtttcaatttgattgcattccaggtgtcattcttgtgcaagttctgagtacatgtgaattattagctcacataatgcattggtttcgatgttcacagatgttcacgtgaaaagcaaaaaaaaaaaaaaaaaatagctaatagacgaggaattcagtagaaaataattgttgcccttcagattgccatttaaaccaggatcgcaaacagcttagtgttgacctgttctggaagataataactgtttgtacctcaaagagctagattttagaaagctctctgcagaaaaaaatatttaaggtgtgaatcctttcagaattgtttatttcatttctcagcattccattgttctagtctagattcatatcagctaactgcatgtctttctctgaagcacactatttgtttttaagcaggagacatgaaaaatgagagttctatattgagatgtaacttggtcacagcagaatgatctccatctagttatatcacagagctagcagagccttaagaaactagagacagggctttgaaatgacagttgcaagtataatgaaatagtcactctctttactcaaagcttatgggtaaagactttttttcctggcaggtttatctttttttaaaatatcagccaccagtcagacacacacacacacacacacacacacacacacacacacacgcacacccactcccacaacacacacaatcccactcacaattttttattgtgtatggtacatttagcagttggggaagaatgtaactttaaatagaagtcaatcttggcagtttcacttttaactttgtactaggattttgtattgtcttttctaaaaatgaactgtgagtgctgagagagaaattctagaacatctttgatctgaatagcaatgcaaatcaaattctagtaaacttatttacttacacttaaaatgtgttcattttttagtcctgcacatattttaagtagaaaaattttcagcatacattttccattctaactttcaatgttagataatcacaaagcaaattttaagaaatcttttatataaagcatctatgattataatcatttagaaaaaggtttcctattacatttggttagaaaatacttcaacataggtaaattgaataattatctggaaaaaaaatcttatagtgctgtagtttccagttttaattgctcttcgtgtatttttaatgagtattcactaattttataataaaatttttatgtgattactactagaaaaaatattttcagtcgcaaaacatcacaattagtcaaagtgtttgattgaaatactctcccatttaactagacaaaagtaataaatttacattttcattggcaaaatatttaacaccttgagaaaaacagttataattctagttaaaaatctaagaagctaacttggatgttccaaactcatcatttttcaaatggttgaattgagatccagagcagtaaactgacggagcctaaattcttttctgtcaacatatagttcatcagactgatgataatatttattgtttcattcttgaagcagtgctttaaaatcagtgtgaaggggtttgggtgattagaaaagtatttgtctatatgcataatcctttcatatttgtgtgtgaaacagtagggtgactgtacaattctaaaggacagttactcgcagttaagcagaaaatgttttcctaatttttcttcattcttcagcagttagtactatgttgtgtaaaactgattcccattttatatttactgagtaaaattaaatcagatttagaaaatattttttggatggcaaagtatggatgaaaatcacttatattatgatatagattaaagtgatataggttaaaaacaaagagccaaacttaaaactacattttctaatgcatgtgttacttaatgtcgacatatctgttggatgcaataactttttctactcactatttgacttatggttaatgatttttggattatattaattcatttggtatttatggacttataatttttttgtaattttacaggctgtatgtaccttagggaaatagaagttaatatatacatctataaatatatatataatatttataagtatcaatcatgttatagacattgtctcatttgatacaacagctccattagggagggaatattaacatgttaacattagagaaattgaggctcagtgagattaagaaagttggatgtatttcacacaaatattagaatccaaaattttaactgaaatctgcacatttccaaagctccatactctttctcattgactctctgctgaagaaatcgagcagtgaagaggagttctagtacattcattatctattggcaaatgttgacagtttcaaaatataaatgatcttaatctattcgtttgaaaattatgatcagccttagtccgtggtagaacctgagctgtgtacatgaagaactagcttgtctgtagtagcagcttgacaagaaaaaaggtatccttaaaggacaacctgccttaaggaattaccagagtatggtggtgaattttcctaagagttttgacagttgctaactttaatatataaatatgtagctcctgcctggtaactacaaagcacaccaaaactattgtactttgagtgttaattgtggtgagcaaattgaaaaacacatttctttgggatacaattttttccttacatacaaacagtatcctcctctattctctctatgagaacagatggatgaagcctcaatatacttactgcccatagcaaaggatgcttttatgagactttcaaattaggcttagacaagagttatgacttagtggatctgcttagcttggtatttttattctgacaaatagtaagaatttctataagggtgaagctgaaagggcaactgagacccctttgagtgaattagtactcctatagcattacctgtatggataatatattttttacctctgatgtgacccttacgaatttaattaagtgtgatggctggccagcatgtagataattccttctatggacaaaatttaaatgtttttttctcactgcgggcgaaatatttttggaagtccatgccaatttatgtcactcaggtaacttttctaacttttaggtatgagagttgaggaacaaattatgtgtgttgtcttgctgttatgttgcatgtctattaacaatagtcagatgtggtagtacagcatggtcagggttactggagatgtattataaaatgtacttttacagatacttcatttttaagcaggcttgatatataaaaattatatggggttttatttttttaaatgtatttctctgtctgtttttctctttctgtttgtgcacatttatgtgtccaaaattagatatcatattctctaaagaaaatgtgaaaaagaaccacattcagtcaatataacgaggtggatttttgttaagatagtaacactggaatgatttctaaaaatctgtctctagtaaagtttgttttctcctctgagaaaatcctattcttagcatcctgatacatagtacttcatatgccttatatttaattgcacttagtgacattgtggtgtgacatctttataaaccaaggcttctcactttaacagaagactctaattggagctttcattcaaagaacatgctgacaggtaagaggtgtagcaaaggctgcatggtgcaacagtactgggttttcaaaaataactgttgtttcctggtatcatggctctggataaagcatcctgtgcttcagcatctctatttcctcacctgtcaaatgttactgacaacaccttcactgtgatggtggacaagtaatgtatttggaagaatatgataaactttgtaatttatataattagaattggaacactgataaaacctactgatgaatgggtgaaaaggagagtactagaagagttcatataatgaaaaaggcaaactacactgattgtctgaggagcaggatagcaatgtgttaaaaacaagggactgggggctgttaaaaattctgacccccacctccactattatgatctcatcttcataccttaccctatgaagttatgaccactggcctccttgctctctctagaacacactggtcatacttggaatgatctaccggataccagaatgcctcattcccctatttccttcatatctctgagtaaatatgacttcatcacagaggctcgcccccgtaattgtatataaaatgccctgctgttctcagtcacattaatttttatccctttaccctgctttattttgcattactaccatatgatgcattgaattgtttatggtcttcccaccaaaacacaagcttcatgagaacagggattttctctctttgtttattgctacatcctcaagagttatggtctatggattaaatgagtgagcaaattgtgctaggagcagaatacttgggttacactttttcctcactatattaaaatggacatgtcagtcaatcatttttgcatttcatgtttgttgcatgtaagtaaaagatgagatggctattggtcctcccatttttacagattaagaaaccacggtttaaagagtttgccagaatggctctttttataaagacaaaaaacaatagattttggcataggcaaggaaaaaaggaaactcttatacattgttggtgggaatgtaagttagcacaacctctattaaaaacataatggagttacctcaaaaagctaaaaatacaactaccatttgattcagcaatctcactgtttggtatctacccaaaggaaaagaagtcattataccaaaaagacgtgaacacctaaacgtttactgcagcaatatccaccatagcaaagttatggaatcaacctaagtatccatcaacagatgactggataaagagaatgtggtatatatacaaaataaaatactattcagccataaaaaagagtgaaataatgtggattttttgcagtgacatgaatagagctggagattattgtcttaagtgaaacaactcagaaacaaagtcaaatactatatgttctcagttataagtgggagctaaataatgtgtacacatgagtataaagtgtagaatgataaatcatggagactcagaaggaggagaggcaggtggataatgataaattatttgatgagtaaagtgtatgacatttaggtgacgtatagcctaaaagcccagactttaccactgcccaatttatgcatgtaataaaattaacctttgtactccataaatatgtaaaattcaaaattttaaaattgtgactcataaaatccagtgctatgaaattgtaagaaatattagaaatataaaactctttataaactctttaaaatatgttatatttttataataaactagcaataaataaatagctataagccagtctataatttggtaggtggaaataatgtatagttaggtcactttgtttatttttatgataactttagacatggataagagttgagtaaaacaattcatttgggtacattaccaatggtactatctgattgctgaaaagtttatagtgtccactttctatagagatctgttataacttgagagcaacaattccctaaatatttaaagctttttgtaatacaactttttgtagatccacttaatttaatttttttttttttagaaaaagagttattaggaccagttagcactattttgactgtgctttcaaattaatttctactttgttcacttgctaagcatattgactgatggacctattataataactcaaaggtctttcaatgtttgtagcacaaggtttgacaagtgttcgagaaacaagatggagaatgattctcacacccaagactttttggccaatttaagtacataaataagaggtctcaacattgttttttcaaagaagagatcccaaaatctgttatgtagagaattttcatatgaaaataagagacaaaacatgaagtcttcatagaaaaccatttaaatgaatgtctagatagctgaagaagcagtctttgattcacaaaggcttataggtgtgtcaacgtcaaataaaatatatagagatggatatctaaatttaatcttttactgggaaaggcagaattacaatttggagcatacacacagacctggtggtctttggtttatatgaagaacacagaagggttggaggttgtgtatattgctgtttgaaaaaagtttattgacactagtaaagtttgctgagctggcattctttgattggtgagtgaagacagtgggtaaaaacaatcttaaagattcggcaggttatttcagaagccattggatacaactggttttatgttacactaggcacttttaccagctagacttcagagagctacctttgtggagcaatattatatgtcctaagtgctttttgtccctgatttattgactctgctttagttgggtatgacgaggataacccaattcgtattgtcaactttcagagttggaaagggaaaaatagtggtgttagtggactggggaaaaaagaaactattttttatcctaagtgttttatactttgcatctccttattaaaatttgggagaaattaccttaagtgggcctagggccatttagaaaaactgataattaattcctgttgctgtttattttccttcaccaggtgaacatattttattttattcacctaaagactttaggccaagcaggcaatatgccaaatgaaaagtttgttatgtggaaagatcttcaaaaattaagcaattttctcattcttaataattaattttaagatacagagttctcatcttaagcacattgataaaattgaattactttttagcttttctctctttttttaaataaggtttagttggctcatgcaactttaaaaataaatcaaatgcttcattagaaatgcacaaataatttcatctgattaaatagaggaagatattgaaatgctttttagtttctgtgttactgattctgcctagctgtttataggtctgttaccttgcacatgctgtttcaaatccactgggggcagtttaaatgaaattggccaagtaaatatgacaagaagaaatgctttttattctcctatagagttaataaaaaaaaaagaaaaagaaatttagtggggacataaggtgaatgagggaaatgggtatgagacatcagccaaaaggttggtacaaatacattgtttgatttttttctgatggaactgatgagtcatatgaaagatttttgacatcagtctatgtatgttgcttatttgcttgacaaagacagcatgaaataatatttagtaaagatttctgaaaaacttctctattgtgtgaagtgaaaaaaaaagtcaggatttgccaaattgcctcttatttattgaaatcttttttttctgatgctcattagaaatacatggttccagctactgccgagctgtaattaagaggaagcataaagtatagaacagggcaagataggataggtgtgtgtgtgtgtgggcagaggtgggtgtatgtagaaaaatgtgatttgaacagtaggtgtagaagatagaagaaatgaactatatccaggtgcatgtgtaatgcatctgttttgtttctaataataatgtattaaaagcttaaataaaggaaacatatattctcagaagaagaccattttaatgtacatctgaacttcatctgtggactaatcaatatgttattctgatataaaaggaaaatacgcttggtctgcaaggattccttagaaaacaaagccaaacaaaaatgaaagttcagatattttttcttatcatacgttgcttttttccatgagcagcagtaacctagacgtttttatctgaaacattagcctggcccagtaggtgtcagattagatatacattactccattatcttggtagactactctgcatcaaaggatctatggacttggagaatgaaagggaaagagaataaataaaggatatctcttttcagttttagagtagcgcttttaacattaagaaaaatcaataactggattgactgcattcagtagggagcattattgtttcccataatgtatctaatgcatatcattaccagagtaatcacattattatctgcctcggccttgctacttgctcggctagatatgaagccaaagctatttgtaaagtaaggtttttccccctttgcaaaattgctgcaaattgtattcttcccattttctttattagttgtttgaactagcctgcacctctgaattcagattaagtggcatggttttttgtggtggttattatttttccccttcaggattcgtttttactctattcaaattaaactcacctttaggaaatgggacacatcatgggtggtttgttgtatcggttggcatgggaaatagagtagtataaactgtaacttagggtgggttttgtgtttctgagataccttttgaattcagcaactgcagtgattgcggagtgtgtctcaaattgtgttaaattccaaccctcctgtgcagggggctcagtctgaaacaatgaagagcatctagagactagtacattccatttattttctctcctgattacaaaggggggtaaaagatgtacttatactaaattttagtggcatatctgactagggtataatgctcatttatgagcttcatgatatttagctatttaaattggatgagacttagttctcacatgtagaattggagtaataaactcgatggtacagatttttggtggatattcaagacaatacatataagatatctagccaagagcattgtagtggtgcacttccaagtggcagtgtaataaaagaggagtggcagagaagaaattctccccagaagagggctgaaataaatacatatggaacatgtttctctatagaattcattatgcttctacatgcaaaggagttgctgatgatgtcttatgaaaggattaacggtgagaaaggaaaatgaatgtacaggaaataattagattatttgattagagttacttgcattcatttttgttctgggttgaaagatcacttactatcaacttgccagaacatttgttgaaacatgttcccgaggaaaacagcaaactaaattaaatcagtaaaaatacatacacacacgcaaaaatagaaagtatttctcctgtattttccttttcacatacttcttgaacttgcttccttgtgctgagcaatgtagtcaaactcagatcacttagcattaaataggaaataagggggacatgcaactggactaattcatggacctggctgaaagacttctgagaatgaaaggatgacatttctggtaaaataattgttctaaggaaacactggttcttccatccttcatttctcatttcactttcattctaaagatgccattatttaaggagagataggagttttctaatcagaaatgcaaattgcctgtctgcctttccttccttccttccttttcttccttccttccttccttttcttcctgcctccctcccctccctcccctccctccctctttccctttctccctccctccctttctccctccttccttaattccttctctccttttttccttcccttgttccttcattttttgacgaccaattcaagagtatgggtaataattgatataatagcccaatttgacacaaatgtgaactttggcaagcaaaccactttataaactcacttgaaagtacttatttgcttacagtcagttgttaagaagataataccaaagagctgccaatatgtttccatattcagttctatctctacattatggaaaggaaaccaaagtacttgggaacaaaaaacctctctgaatacagatttcaagagcattgttcaattgggaacttgcaagaggcagagcagaaaatggatgttgtagttttccttttagtccagatggaggcatttaaaagaatcatgcttttaggatctctggaacaaaccagcggagcttataatatgaagaccaggcattactatataatatgtagggaatgcttttgctgtgatctttaacttttaacctatgttctgatagttttataatattactcacctggtgttcaacaattcaaattacatacacaaacacacatgactgtagaaaaagaagcacattttgcaatttcccaaggaaacaagtttgagaaatatgtgaaaaggaaagtataggagaattactttctatatgggtgtttttattattgtttaatttagtttgttattttcctcaggaatatgtttcaacagatgttgtgccaggttgatagtaagtgatctttcaacccagagcaaaagtgaatgcaagtaactctaatcaaataaactcttaatagcctctggtcagtgagacaggaattgtctagtcaagtttaaaaaatcaatagtggccactcaaaattcaactacagttagaaactaacaaacttgaccacattccgaaagatcagaagttatttcaatctgacttcttctttcctaattgaataccttttatttctttctcctgcctgattgccctggccagaacttacaacactatgttgaataggagtagggagagagggaatccctgtcttgtgccacttttcaaagggaatgcttccagtttttgcccattgagtatgatattggctgtgggtttgtcataaatagctcttattattttgagatacgtcccatcagtacctaatttgttgagagtttttagcatgaagcgctgttgaattttgtcaaaggccttttctgcatctattgagataatcatgtggtttttgtctttggttctgtttatatgctggattacatttattgatttgtgtatgttgaaccagccttgcatcccagggatgaagcccacttgatcgtggtggataagctttttgatgtgctgctggatttggtttgccagtattttactgaggatttttgcatcaatgttcatcagtgatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcggctgtgaatccatctggtcctgggcttttttgggttggtaagctattaattattgcctcaatttcagagcctgttattggtctattcagagattcgacttcttcctggtttagtcttgggagggtgtatgtgtcgaggaatttatccatttcttctagattttctagtttatttgcatagaggtgtttatagtattctctgatggtagtttgtatttctgtgggatcagtggtgatatcccctttatcattttttattgcatctatttgattcttctcttttcttctttattagtcttgctagcagtctatccaggagcttcctggattccttgattttttttgaagggttttttatgtctctgtctccttcagttctgctctgatcttagttattgcttgccttctgctagcttttgaatgtgtttgctcttgcttctctagctcttttaattgtgatgttagggtgtcaattttagatatttcctgctttcttttgtgggcatttagtactataaatttccctctacacattgatttaaatgtgtcccagagattctggtatgttgtgtctttgttctcgctgtttcaaagaacaactttatttctgccttcatttcgttatgtacccagtagtcattcaggagcaggttgttcagtttccacatagttgagtggttttgagtgagtttcttaatcctaagttctagtttgattgcactgtggtctgagagacagtttgtcataatttctgttcttttacatttgctgaggagtgctttacttccaacaatgtggtcaattttggaataagtacgacatgctgagaagaatgcatattctgtttatttggggtggacagttctgtagatgtctgttaggtctgcttggtgcagagctgagttcaattcctgtatatccttgttaactttctgtctcattgatctgtctaatgttgataatgaggtgttaaaatctcccattgttattgtgtgggagtctaagtctctttgtaggtctctaaggacttgctttatgaatctgggtgctcctgtattgggtgcacatatatttaggatagtttgctcttcttgttgaattgatccctttaccattatgtaatggccatctttgtgtattttgatctttgttggtttaaggtctgttttatcagagactaggattgcaacccctgcctttttttgttttccatttgcttggtagatcttcctccatccctttattttgagcctgtgtgtatctctgcacatgagatgtgttttctgaatacagcacactgaagggtcttgactctttatccaatttgccagtctgtgtcttttaattggagcatttagcccatttaaggttaatattgttatgtgtgaatttgatcctgtcattatgatgttaactggttattttgctcattagttgatgaagtttcttcctagcattgatggtctttacagtttggcatgtttttgcagtgcctggtactggttgttcctttccatgtttagtgcttccttcaggagctcttttagggtaggcctggtggtgacaaaatctctcaggatttgcttgtctgtaaaggattttatttctccttcacttatgaagcttagcttggctggatatgaaattctgggttgaaaattcttttctttaagaatgttgaatattggcccccactctctcctggcttgtagggtttctgccgagagatcagctgttagtctgatgggcttccctttgtgggtaacccgacttttctctctggctgcccttaacattttttccttcatttcaactttggtgaatctgaattgtccctgtttgcagatgatattattgtatatctagaaaaccccattgtctcagcccaaaatctccttaagctgataagcaacttcagcaaagtctcaggatacaaaatcaatgtgccaaaatcacaagcattcttatataccagtaacagacaaacagacatttgccattattgttcttacacttatgaatgatatatgttattgttttatttgcttagcatgtctaatgcatatcatttagtggaagcatcccccaaattaggagctccattgtcaaaggcattctcttctaaggtttccagaactggaggcctcaggatacagtgctgtacagtagctcaaaactccagttttgctatcagatagactcatttctgaactctgacttatcactcttttctctgaaacaagtatctttttctgttggaaactcagtttcttcatttacgcagcagggctattcacagtgcttagctaatggcgtttaatactctatacaggagaattaagtgaaacacttcagctaatgtgtaaaatatctagaacagagtaaccactgcatattcctattgtagtataacatacaatagctgacatagctattataactctgtgttttggtttggattacttacagtgattcatatacaaagcccacatattttatgaagcatctactatgtaagttactctgctagtttttataaaatattaaaaataggtataatgtcattctttttattaagtagcttctaatcaagcaagaggtacactgataatacattagtgaatgcaatataagttataattgcgataggtaaaatcaagtaggaaaaaattctctagtggtaagaagaaaagagagatacctttcgacttagtggaagataatcaataaactgtagttattatttttaccattgttgttgctaattccaaatacaaagcaccctagtagagctaaaccaataggtctcttaaaatacagggatatcatgaaatgatttattaaatctgttaacagcattcacatgaaatctcttttgttaaaaacaaataggaaagtaggcaaaaaggtattgtaaaaagtttagattctatgactatattgtgcttaaggcaagtagatctcattgagaagaaatctattgctgattaaaatatgagctatctcattaatcacacagtacattagataataaattgtggttgttaacttgatatgcaccattgaacatggagaaaaaatatcacataggcagacaagtgctctagtgtatgacagtgtaatagcttgtggatatattctttttgtaaatatgtctgctgcatatcttatgtcttactgaactgtgctgtaaaatatggttattctttaagtcacagacattaatgctgaagatttttcaacactggaaaaaatcatgcatttgaatagaagaaagcgtgagatagaaattaacatttttcactcagagtatgtcattctaatatttcattcagttttctaagggagctttgaagatgttagattttaaaaaatgttttggaaaaaaaaagaaactaatgacatagtccactgacaggtaattatgtgaactaattgcacggactgatgtaaactgtgatcaaggatatttaactgtctgttctatatggatctagtgagccggacctgaaaatttgctgataacagaagtagaaaagaatggaaaagtgttatgttctgtagaccagggaacactttttttttttaaagaaagaattaagatttctttaaattttgttttcgtaaatgtacaattttaccatgaagagattgttgaaaattaattttgacctggccttgtgttcagtttgcttgacaaagtaacatattcagaaaactggacgagtttcactataaatattgtttctgcttctgtccaatatggcagccactagtcatgtgtggctactaagtacttgaaatgtggttaatctgaattgatttaggctataagtgtaaaatacaggccatatttctgtattatttttatgctttatcttctttaaaaaaaggtaaaatattgtacttggatatataagttttaatgagatgtgtcaatttcactggtttctttttaactttttaacagagagaggaaaatatttatactcatgtggcttccatttgtgatttgttatgtttctatcaaacagtgctgtttttttgtggtacatgaataaagtgactgatgatggaaacaatattctgaagaaataatcttgacctcctcagaaacacattaaaattactcacattgtggccataagcatgtttgttttagtttatgtataaatcattgtaaagaaaccatataattcaaaatatattatgcattttaaaaacgataagaaaaatgatataaaatcataaatgtgtggatagataacagtgcaaaatctgaaatgcagaatagccatttgttaggtgaaacatgtatgttcatgttcttatataaagcatatgttccaccagtaattgctgcattattcttctattatattattagaggcattgtgattataaaggaaactcttccccctatatggtttaaacgtttgtggaaatttatcttctcactgatgaattttaaatgcagaaatcaatacaaatcatttatgcaagaatctttgcccaagtcccttccatctatccctgcaaattcaaaacaaaacagtactctgtctgttccaacaaagactacatggaacatctccttttctctccttctgttttcttttcttagatgtgtttttcaaagggggaatgagttaaagacagaaaaagcccccagtgcagtcacaagcaagaaaaatacaataagtgactctcaggatttattgctttggagtactacaatagactatctttgggttcataataaatgaatctttaatacctgatagaatgcatacatatctccaagtaggtcatttatgttttcatttacattttctaagattcttcatttatatttttaaaatactgtgttcttccaggaattattccatataaattcaaagtacaattgttgttcccctagaaatggagccattatataccaggaatcactgtcagaagggaatgtattctgaaacgtttttcacatgcatatgtgttggatgtggttattctcacatatatgtccttcgtagaagtcgtctgtaagtctgtaagagccactgctgggcttgtatgtgggggccagatctgaaggttaattcctgttaaaaataagtatcctgcatatgcaggtctgaagcagaaactagcctgtgaattctaaacctctgctgtccaatacagtagccactagccacatgtgggtgtagatcacttggactatagttaatgtgacaaactaaattttaaattttatttaacgttaattaaggtaaatttaaaaaccatcactggattcagtgtttgaaaaacttttaagtatatttggaacaactttggatttactttttcaggaatacattttatgttatctaaatacagattgagtatttgcagccaaaaaatttcaaattgagatgtgctgaaagtataaagcccaaagcagattttgaagacttagtgctaaaataaataaacaaaataactcctaagtcattttacatagattggatgttgaaatggtttggatatttgggttaaaatatattaaaattagttttacctgtttctttttattttcttaatacagctactagaacgtttaaaattatatatgtggtttaagttaaatttctatggaaacagaagaggaaaatacatggaaatatatttgaggtaacaaggttacagatgggatatagtgaccagaatgaggaactagtgccagcagagtgagagtgggtagcaaatggaccaaaagagaagcagctccttgctctgttggcaggtcagtagcttgtaattcctgaactgtcatagggctcaggatcaagaacgtgactttttagcatttagtgtcttatgatcaatgacagacaaatacattattatgttgctttaataataacacaattatttttataatttaaattttttattcattttttaatatatagagatggagtcttgctgtgctgcccaaatttgtctcaaactgctgggcttaagtaatcttcctacctcagcctgcccagagttctgggattataggcctgagccactcagtctggccaataataacaaatttaattattttttaaaagtattactgtatttcagtcttctttcagcctacaatatggtattaaatgccttacatggagacatataaaggattttaccataataacctttaaaacaaaagtgatttcctagaattataggacagaaaaaagaatgttaaaacaaatttcatttcccagggtagaaatctaatggaacattaacttggggcactttgttatatcaaatctagtccatagctaagaactggattagattaatcctttggacagtttggaacaaattgtattacattgtgtttgccatggaagtcttattgccttcatgttgaattaaaatagcctttctctctacataagtgaaatacaagctcactgcagagaaatcagaatactaacaagcaaaaagaggaaaacaataatcacttgtaacccataccacccagagataatgactgtaatttttccttgcattttcttcaaggaaacattgttggtttttagccagggtttggtatgccttaataagcactgcatcacaaactctgtatttaatacttttcacccttttctttgaactctctttgggctgttttcatagcccagactgaggttatctgttgtagaacaacaacttaataaatgatgtcttgttggcttgaaagtactctttatatagatttccaaagcaccaaacataaagccaggaagttctttattcactagaaaatcttgttgaacattttctgacattattagtacaatggagagagtgaagatgaaagaagaatgaagaattctgaatcttgaagagcctgtgcttattagtactttcagcagaaattatgaagggtcacctcatcagcagattcatgaagcctcattaggtaaaggctttaaatgtttcaagagtaatccctcatagaaagccttataaccatcctaagcaaatgctagacaaacatgcctacctgcccatgttgacctttgattggcgagagtttgtgtttcctctttaagaggaagatgcacacccaagtgtgaaactacacagacaatttagcagtgctgtatctgggaatgcaaacctgaggacctaaagtttggcagaccacttgagatgaagtggagtgcaaagtgtccttcgtccattcttcagatagttgcctccattctctctgattttcattctctctattgtcctttcactcagtcttgatattcaactatttttaggacagttgaacaataaaaacatgcatcctgaagttaggaaaaacaatggcttggtgtcctgttccagaatcttctgtgtttattgattttgagataatttgttacataaataccaacgtctctactgtcccttacccaactcccaccctatccctataataagggtaactttggggaatatgctgcagattctttatctccgagttaatctccaggtgtagatcaatgccaaaagttcttagaactcctaggaagttctcagcttctttgagtttctggtccatttggcaggaaggcaggctgaaggggaagagtcaaccaagctaccttgagaagtaagtggaggtgctgaaaacttcatttgcgcgcccctgaactaggttaaacactagaaatctgtgtgcttgatttgcgaatttggtacatatagcctttatttcatggcaatgttggccatcaagctgcaaaggatttttaacatcctttaaataaaggacataaaatgaaataccaccacattgtctactgtgggactgctacagtggacaatgtggcagacaagatatatacgatgctattaagaatatttgggttatactcaatttcaagtgatagaattcatcaatattttatttgtattttcataattttattcatccaatgttcatcttttctgtgccaggtattttaacgagctctggggataggtacatctatgaacaaacagcagatgtgatttctgacctcttgaagtaagacattaatttatagttatataatattccttaattcctacggagcgagaaaagtaagcaatgacacagtgtaattggaagtgctagcataatatgaagattcaggaaaaatcttccttgagtaggtgacatttaagcgatgaaatgttccctgatacattgctagatgctatgactataaagataagcatagcatagtccctatccctgagaatttcatgtctaggaaagagacttgaaaaccaatcacagtcatttattaaaaagcctctacaaaagcatatgaattgtagtggattccaaaggttgtgggtgatcaattctagccatctcagaaaagaccttatgaaaagagattactttaaatgtgagttttgaaagacaataatgttgaaggctgacaaagattaccaggcaatcaagacaaggaagaatatagcaagtattgtctgtaagataaaaaaaaaaatgcctaatatgtttggcaaactctaagtagagattaaggtttgggaaggcaattgaccaaaggtgaaattatatgtaaagcaagttggtaaaatataaaacatgtgaaatgttgtatgaaagagtttacacttctctttttgaagtagaagaggcaatggagtattttaatcaaggatttgacattgatttgtgatttaagattgatatttctgagtgcaaaaggaacgaagaatttggctcctagataggctgggctcagggaaactgagtaggagaccattgtagtagccatgagagaagaatgaaggacctcaaatttaacagtagctggggagattcaagagatttttaggagtgaaaaatcaatgctaattgaagagtgactggctaggacagatgaaggagagagaggactctagaaaatactgagatttctaccttctggattatttatattatccatgagacctctgctagctagtgaaaaggttaagatttggggtttgaatcctgcctctacaacttgtgaattatggggcttggaaggagttacttaaatgtgacaagcctcagttttcttatctgtacaaaagtggcttaaaataattttgagagattcttgggaagataactaaaaatccttcaagaatcctcaattaagataaattatatagaatcaaatggtttaaggtaagttcagtgttaggcatgccaatttttaaattagcattgtctttctggatggatatgtccagtaggtattcagaaataaggactgaggacttgagaagggggtgcaaacagaagcctaagaatttggagatattattattatgtgatcttggaaatcacaccagtgggtgtgattgctccaggtaaaacgcaggaaaaggtttgaaatgagttctcttattgcagtatctaataagtatgcagaagaagaggaagagctcaaaaaatcaactaaaacatggtttaaacatagaaaaatctaaaaaacaagaacaaaagtaagaacatgtgcctagtgtaccacaaggggtattttaagaaggaaccattagcactctggcaaatcttatagctgacaagtagcttgaggaatgaagagaactctgaatataacaacaaagagatcactgtcagccttggagagagaaatctccatatgatggttaggagaagagtgcagattggggtgatttaaggggagaacagaaatatagaaacagtcaagagaaatacagtgctcctgtacgaagttagtcatacagggctgggtacaggataaagaggcttgaattcctagtaacagataataataataaggacctaggatcgagcaaagggggtaatgattggagataaatgatgaaggaatgctctagaagtgactgcagttcaggatgtaaaaaacatgtaaggaggcagggcgcggtggctcacgcttgtaatcccagcactttgggaggaagaggcggatcacgaggttaggagtttgagaccagcctggccaacatggtaaaacccggtctctactaaaaacacaaaaaattagctgggcgtggtggcaggcgcttgtattcccagctattcaggaggatgaagcaggagaatcgcttgaaccccgggggtggaggttgcagtgagctgagacctcgccactgcactccagcctgggcgacagagcgagactccgtctaaaaacaaacaaacaaacaaaacaggaagcattaatctaagatggaagaaggtgaaaccttcttttgagtcaaaatgtaagggagcaagtttagaaagaatattagtaaatggaaattaagaagcttccagtattaattcacctgttgtttgatactattcacttttatttttatattttatctgatactttatgtgttgatattttatctaataacataagtaccttaattgctatcatgttttaatgttatctttagataaaataaattattatgttatcacccaataaaagctaagtgaaacctcatctctgtctgctgcctcctacagacacacacacacacacacacacacacacacacacacacacacacatatacacatatatacatggaaaatactgattgttaataaagtagccccaagaaaaataggatctcagagactataccatcagtgctagggttgaatgttatcagataaatatctttccctaatgatttgtagctcttcaagaaaccttggaactaagcttcatgaaggactgacatcaggacattggagtatgtgttaaatatagctgtttcagaataaaatgatttgtattatttattgatataaatgaggttttgcttgagcatttgcttgttggaaggatgtttttacatagccatgctttgttatgttaactgttagctcaagcttaaattagaattgtaagcaattaattttgtatcatgtttacatttaaaaaacagaagtaccacaagacctttcctagtgaatgaacacatagtttaattagatcatcttgactttattgtatgataagcacataaacataaaaggcttcttctaattctggtgatttttgaaataataaagtccagattctggatttatatgatgaagcaattgcagtagattgtgtagatagaagagcacccatttgaaaaaaagagtccattattttttgagtttttgattatggccattcttgcaggagtaagttggtattgcattgtagttttgatttgcatttcactgatcattagtgatgttggacattttttcatgtttgttgaccatttgtatgtcttcttgtaataattgtctatccatgtccctagcccactttttggtgggattatttggtttttttctttctaatttgtttgagttccttctagattgtggatattagtcctttgttggacgtatagattgtgaataatttctcccactctgtggatcgttggtttattctgctgactgttactttagctctgcagaagctctttagtttaattaagtcccacctatttatctttgcttttgttgtatttgattttggattcttggtcatgaagtcattgcctaagccaatgtctggaagggtttttctgatgttaacctctggaatttttatagtttcaggtcttagatttaagttcttgatccattttgaattgacttttgtataagcagagagaagaggatccagtttctttctcctacctgtggcctgccaattatcccagcaccatttgttgaatagggtgtactttctccactttgtttttgtttgctttgtcaaagatcagttctgggttctctcttctgtcccattggtctatgtgcctacttttatatcagtcccatgctgttttggtgactgtgcccttatagtatagtttgaagtcaggtaatgtgatgcctccagatttgttgtttttgcttagtcttgctttgactatgcaggctcttctttgggggttccatattaattgtaggattgctttgtctagttctttaaagaatgatggtggtatttggatgagaattgccttgaatttgtgattgcttttggcaatatggtcattttcacaatattctacccatccatgagcatgggatatatttccatgtgtttttgttgtctatgatttccttcagcagtgttttgtagttttcctggtagaggtctttcacctccctggtttggtatattccaaaagtattttatttttaaattttggcagctattgtaaaaggggttgagttcttgatttgattctcaggttggtcgctgttggtgtatagcagagatactgacttgtgtacattaattttccatactgaaacttggctgaattcatttatcagttctaaagctttttggaggagtcttttgggttttctaagtatagcatcatatcctgctggcatggatgtggtgtaaagggaacacttctacactgctggtgcgaatgtaaactaatacaaccactatggaaaacagtgcgaagattccttaaataactaaaagtagaactacaatttgatccaggaatcccactactgggtgtctacccagaggaaaagaagtcattatatgaaaaagatactttgtacatgcatatttatagcagcacaattcacaattgcaaaaatatgaaaccagcacaaatctccatcagagtggataaagaaaatgtgatatatatatgaaggaacactgctcagccattaaaaggaataaattaatggcattcataacaacttggatggaacttgagattattattctaagtgaagtaactcaggaatggaaaaaccaaacattgtatgttcccacttataagtgggagctaaactatgaagatgcaaaggcatactaatgatacaatggactttggggacttgaggtaaagagtgggaggggggtgagggataaaagactacaaattgggtttagtttattctgcttgggtgatgggtacaccaaaacctgacaaatcaccactgaagaacttactaatgtaaccaaataccaactgtttcccccaaacttatggaaatgaaaaattttaaaaaaccacatagtccaaagctgattggaattcttcattattctcactcaaagtcagcatcatctcaaagtcattgaaaggaataagtttgcatagaacagcttggattttgggttatcttaatattataagtatcttaatggttattatcttgctcgctttgccttacagttcacttagagttttattttgattttaccatgatgtaatgatctttagtattctgtccttggtctgtatctcttcttcaccagcctctagctaggtggcctcagtcatattttcagctttgctatttattgtgttctagtgcctttgaaatgagtttcactagctatgttcatgtatgtaagtccaaacgctgaaggcatatctttttaaatatcccagcaggattcatacttaatatttcaaaactgaacttgaaccttttctgtgaaacttatttgtcctcctgtatttcctactgaaggacacaaccaaataaaaagagttaaactggaagaaaaccatagttccaccatcaaggtaaaatcagtcaacatattttattttactctgggcttttctctaagcatggcatttgttttcaattgtgttaatacaatttttaaatttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatttttatttttattattatttttgtagatatgggttctcactatgttgcctgggcttgtcttgaattcctgagctcaagcaatcctcccatctcagtctcccaaagtgctaggactgcaggtgtaagccactatgcctgactcattttaaaatttatttaaagaatattgacatttttttggtgggggggttcttttatcttacaatgttgatattggtaatttttacttttattttaaatagccctttcacccaagttttaaatatttttgcaatttagcttaaaagagtctgttaagatataaaaacaaatctatcttaagttttgctacttaaaaatttctgttttataaaaattatcttttattttaaaaattttgttcagtgtggatgaaaacttttttattagcattcagtgttagttacctttttatgcttaacatttcattttgatatagtctaatgttcccttttttacatgctttgagtttagtttgttctttttctacctgcttaattattattactttttttttgtcggagttttgctcttgttgcccaggctggagtgcaatggtgcaacctcggctcactgcaacctcctctgcctgggttcaagcgattctcctgcctcagtgtcccaggtagctggggttacaggtgtgcaccaccacccccaactaattttgtatttttagtagagacaggttttcaccatgttggtcaggctggtcttgaactcctgaccacaagtgattcacccacctcggcctcccaaagtgctgggattatagacgtgagccattgcacccagccgttctatctgcttaatttaaacaccctgttcaatacatatacatatatatatataaatacataaatatgtatgtattttaaaatctttttgctatatatgattagaatgttatattgttaaacgcatagttagcacatttcacaagattcgataggcaatatttttattgttatttagctgtaagtgttttataatttgctttatagattcatttttaattcaggaattatttagagatagaatttttcagtttccaatatatataataagggaatatcctttgtggttttaattttgttgctcatggtctgaatgattgttctttatgagttctttggaatttgttaaaatttcctttttggcctacgtattagatcagttaatgctagttctaaaaatatcagaagcttaatcaaataaatatttttcactcatgaaatctaaaacacatgctccaactaagaggcatcttcaggattctaagatattgctgtatattggcatcctaccactaatcagggaagaaagaggctggaggattgtcccttaaatttagatgctcctgaaaatgtttaatacacttttacccacagtccattggccagaattcagcttcatagcccatcgaacagtagggatgactgagaaatgtagtttaaccatgtgtccaaaaggaaagggatgtagttaggagaaaaccagctggtgtctttcaagccatacatgttgttaatttttatatatgttccttcttcactagaaagaagaaaaatctatttactagttgattgtggggtttaatgcatcatgtcatttaaagttgttcattgtgttctatgaattatagtcttattaacattttttctttcgatttatcagattctaaatgagaggactacactttcccatcatgaatgtgaaaatctttttccttttttaaaatcagaagactatattgttaggctcatatgatttcatattatattatcacattattcttgttaatgttctttggcttaaattctcttctggctaatatcaataaacacctgctttattttgggtaagttttgctaggtattctttcatttcacatttagcttctcatgttattttaggttgctatcttacaagtagcctatgattagattttaaaatatccaatctaatagttgatcttctgattaatatatttacttcgtttacgtttgttatgcttattgtgttacattttgctctgttgatttgtttcctctttcttgtttttattgaatcagtaggatttatcccctccttttcttcttgaaattatggatgtcatatattgtattttcatccctaaagagtcacactccaatatttcataacaaagaataaaggtatcatatgtatgcatgtacatgtatgtttgacgaggaccttggcatctactgcttttgtctaaactcccttacttatccttcatccacttttagtttcctttttcttaaggcatgtaattatttccccttaatttttggacacaaaacttgtttgattttatagtcaatatttaatcataatatggtttgttttattttggcaattttgcttctctttctgttcttttacataaaatcgcatgtcacgaaaagagataacgagattattaacagagctaagcaagattgagggagagaacatttttcttccttgtgacagtttcctaggtactttcttattttctaaggtatttctttttctggttcctggaaaatcttttgtatattcggagatgaagaagacaaagaaatgatattactgataaggactgaactaatttattataaaatataaccagttcatgaagggttttaatattcaaccatctcaaggcagtgatattatataaagaaacttgaacattaaaattcttctccataggactagaattttttaacctcaaagtaaccataatgggtgttctaatataattttaggttttatgaaataatcccaatataacaatttacagtttgcttaagagttaatgttttaactttctctgcatttgctgtttatagacttacagttatataatgattgacttctcattctttttaaaataataactatgttattattcaggactgacttcagattcttacaaatacactataattaaaaaagtaaaatgattggtactcatagaaaagaaaatagaaaacatttgttttggatagaaatatgactgaatatctaaaaaatgcaagagactttaaaataaaatttaaaaacaagtttaacaagttggttatagagtgaatgtgtgaaaataaatgggtttttattttatgtaatatgggtaaaaagacctggagtggttacatgtatagatagataaaataacgctttaaatattcaactgtccagtgatagctttggggaaaaatacatctgcaaaagagatgctagagttaatatttatgttatggaagaacctcttttaaattgacaaaaatttttcagattaaaattagcagagtgtatgaataggtaactcactgtgggactaattctaatggcactgaatcctatgtaaagatgctgacacactagagaatataagtaaattcattatcatatttatcagactgcaaaatttaaaagagctgtattacctgttgctggtggggatgtggcaaacgtgaacaattggttgttactgatatacatgcaaattattacatcatttctgtcacagtcataacatttcaaagtacatataactttcattttgatatcccaattctgtaacattatttcttataaataaaattattagtaagtaaagatatatgtacacagatatttactgcagcattattcatagtaataaaaaggaacattaagagatttcctatcagtagaggaatattggaataattacggtgcccccacactatggtgttgtacataactaccaaaacagtgaattagacttacatcacttaaataatttccacaaagtacttaagtatgaaaatcaacatatgaaaaagtgtttataattgttttaattgcaaaaaaaatcatccataaatgttttcatatgtatgtatgtctatttacttttaattatttaggctttaacaaaaaccatgaaagatctatcctaaattgttatccaatatttgctagaaaggagtgaggagtgtggagtagcagtaggggggaaaaggaacgacaagccaatatgttaataccttcagtatataaaataaaatatatgtataacaaagtaataaaattagatataaaataaagtatataaataaaaatccacggaacaaaaatatcttaaaaatctagaacgtatgttactccatttacatatagttataatgaaaaaaacaatataaaggcaataattaagactgtgaatgaagttaatatatctcaacaagatatttgaggagattaaagttaaatcactgggaaatggtagatgcctgacaaacactcttatctgggaattttacatgaattttaaatttagcacttgagagatatttgggttcaggtcctcatcaaatgcattctcatttatctcattattataacggcaactgtaagcaagcactcagagatctatgtgtgaaagatttacaaatacctgtacccccccctgaagcaggactctcgaaactatttcctgctgctaaatgatggtttttatcttctaaaataagttccggaataaaaggaaacaacatagggtgaaaaggtcatgaattttacagttaactgggcatcagctttatttcaggctttgccacataccaactgtgtaatgaagggtatataaagacaataaagccacaattatctctccattaatgtgtcataactatatgctgataactgtcaataccagtcaaatggtttggatgatcagaggtcagccactagaggagaggagtttgtcatagcttagattacttacctgtgtgaccttgagttagagattcttctgtttattcatccccaaagcagatataatagcaatgttatccatagggctgttgtgagaattcagatggataacacacgtaaagcactatttagagtgctacacatactaaaaaagtattcagtggaaacaaccaaaaataataaaaaaaaatcgtatccaacgtggccttggaacataggtctagggggaaataactggggcaaacctcagctacccaggactaatactttgggcctttttttttctgcctctgtgtgtgtgtaataatgaagattaagtgttgtgtattatcaaggaaaattgtccaccttgaacctaatgataaatatgaaaacagtaacaaaacaataaaataaaaaacagccttagaaatgtgaaagttatcctagttacagccattaatcagagttactaacgatgcattatttattactatccagcatattatctttcctgtgcattgcaacataccagcattactttctgtacaactctggccaaattatttgctctcccattacttccgttgtctcaggatatcaataagcattttcattagagaaactctaagttctatttcagttttaaaatactatgactttatgaccaagaaagggtttacctcccagttttgtacttagagtcaacacttaagagaatcatgaaagacttcttgtccatgttgatgtgtttattttctgagtctaaagtctttctcctccttctcatctatcttccccattaattcttcaagtttcttctccacatattcctttagcgaccttcgtattgccttcattttcctccgatgaaagatgcaaaaatggaatctagagtaggaaaagaaaataattccaacttcaatatcagtagccccattctttaagccagttatacattgttttttttttttttttttttttttttttttttttgctggatacttctccatttccttttgttccaactattatcccgtcaaactttgcattttattcctttcagtatcccagaatttaaaatgacttcttttgctttatttccatttggaggaagagggaatttgggcagtctcttggcaaaaggaatatttgacccagtgtttatttggagagaagaaactcacagtaacacagcacttcccagtattacagctgttgccagcaatatgagaaatagagcaatctctcgattctcagcctttcttggatcctcgtctggaaggagaaacaggaaaatatgaaagtgagttttggagaagagaaatagcttgtgacatttattcagaatagaaaactcttttaacctcagtttgccctgtttactacttcatcactgttccatgcttattttgacctttattacttttagtctcctaggttctacaaaactgttgctgatagctgtcagcaaaattcttcccagcctaatttcttcattccaagcctagcctcttcatttctcagcctttcagttgattcagtgccaaattatttatactggtcaaaatttcacccaacaccctagctccattttgtaacactaccatgacctccattaaaggtcatgtagtgacccaacaaatacatgtagaataaatcagtgagcaaccctgctccttaatccctgtcccttcaaaattccataccatgatctttgttacctccacaatattctcctttgaagcacctgttagtcatgcgaagacacgtccaacaatcaagaatgggaccttcaaccacaactgataaagaggagaagaaagataatcagaaagagggcatggcacgagggttccttagtcatacatcaagtgtggaggatttgatctcaagcattcccaggactctcaagtttgcattgctgtgaatttcttcttctcctagaaatcaagtttcttgatggatcaaaatctgtaagtctgatctccaggaaaaagcgggaaaaggatgcctcagcttatactggggcaatgggttgtaaaccatatgttagaaggcctcctagtacctcaaaaatatgtggggtgtctgagatttcatgagctaggtttcgttatcaggtattgttgacgttaccccttgtaaccacagctctaggaattggtttcccagtgtaacaggtgggagagatagggccatatagagcaaaggagatgggaaaatatgggctgaaacctcaaggcgtcacatgtactgtactcactgcaatcttcagaacaagctagaagagaatcagaaagttctaatgagtttaaaaccagctacagtttgccatatttatacccaagtagtctttgtttaccctttaagttccagttacctctccacccattctaaataactctattatgaacttgcatttcttccctcatcccgcattttctattcccttcatataacttcagtgctgttatatagaaagttttacttaccaatttcagagaagttctttagtaattctttcagtttggattccaggttttggcagacatcgagaagcttgccttgatagataaagacacctaagagggagtggaaggggtgtcaaaaaatagaagtagctcttcccttcagaagttaattatgtctgtttttatctttgttttccccagccaaattttctgaggcttgcttgagcaatacaaacttttaacattgaaacagtacctcacctttccatgtttcattgcccagtttataaaattcattcttcaaccatgttctcaacttaacaacctgctgaacagctagagagggagagtaaaggtacatgtaggggaataattacatctatgcaggaagttatgtagacccaggtgttctcttccttgcctcccttctccgtttaagcccctggactctcaggaactcaagcttccctcacccaacacccgaagcctcttgtcactgtgggagaccttgaagcttaaatgaatcatctccttaatctgccgttcaagcagctgagttcggccggggacttctgaaggtatcagatttcccagcaaggagccaacatcctctataaatttggggtcacattctaaacagcctttgactccatggaaggctgagaggggcaggagcaggaataaccacaggtcacccatttctttcttcacccccgctccccgacagcaggttgtcctggcaactagttcacttagttccttttccttcaaaaatccgggaatgagagcctggttctggatagtctgactccacttttcccgctgtttccatcccactatcgggcaatctttagttgtttagtttaatgatctttagttgtttactgactattatccttcattctaggagagggaactgccagctggggagcggatacctgagttctgagtgtagaacaccaagagatagagaagccttgagctcacacaagcagagttctgtgcagggagatgtctcagaaaaagtgtttctttagccctctccctgacttgcatcctcatgagactcttaaaccccctcctgaccttcagagatgtttatcatcagagatgggttatggaagtgatcctatagaacctgagagattgcttaactcaaactctgcttctacattagaggtaagaaaagccaagaatattgagtttcttgcgggtctcggtccctactggggcagtattgttgacaaatactggtggcagtattgttgagaataaaggagtgagcatttatctagaataatatttggcaattttaatagacagtaacatatttcaggctacatttatcactaggatgattttctagacatgacttgtaatcttttccttttcttcttgctttcttctcttttctttcccttccttccttccttccttccttccttccttccttccttccttccttccttccttccttccttccttctttctttctccttttcttttcttttcttttcttttcttttcttttcttttcttttcttttcttttcttttcttttttttcttttcttttcttctttcgagatgggatttcactcttgttgcccgggctggagtgcaatggcatgatctcagctcacttcaacctccgctcccgggttccagtgtttctcctgcatcagcctcctgagtagctgggattacaggcatgtgccatcatgcctggcttattttgtatttttagtagagatgaggtttctccatgttggtcaagctggtcttgaactcccgacctcaggtgattcacccgcctcggcctcccaaagtgctgggattacaggcatgagccactgtgcctggtgatttctaatctttttatagcattcttcttatagagagtgtggagtcagatactagaaacaatagttgaggaatactgagtgatgaatccaataaagttcagatcctttaacaagtgcattctaaaatactggcaaagtatgtaacatataaaaacatagtggttatcatgggcttccctctcagaccacctacaaggaagatgtccaaataaacatgttctcctttcaatggccctttgaataaaaatattctgtgttatttgaataaattgaggttgcttttcagactcttaagagcactggttacctcttttctaatacattgcctgtatggctgtgaccttctggaaaccaggaaacactggcaatctacagggttagtggtagaatttatatttaagatatggggtgatcacagtggaatgttgtgcgggaagttaaaagaattaccattacttatacgtctaccaagtccatgtgacagacattgtgctaaacatttcaggtagtcacaaattctcatggcgcgcaatcctttggagattgtcatttctatgttactggtaagaaattgagactcagagatgtaaaagaatcctcgctggaagaataatttagagtatgagttcagggttcaagctcatgtcttgtgtggttccaaaccctatacattttactgcctctcaacaacaacttgctgggataacacagaaaattatctcttggaatttgataagtcaaaatatgaaggccaatacagattacttgatttatggtttaaattagcatatctctgctcagattttttttttattcccttggctagatgatctcatttttagaggatttcccaaaagattttcacatgctgaggtctgaaggcaagtgagctaatgggattaaattaactctagatagtaaagttgaaaactaaaggggctaaaaaatttggcagagaagtggcaaggtatgagaacaaactgtgcttcaagaaaagatatgcattatagatattttccagtcaatgatccataccttcacttagacagttcaaagagtatcctctgacacattactgaataattcaatggcacattactttaacccagacttagaggtccatctatcatttttatcattgtctcacccttccagcttaaatttcaatcaggtttttagaatgagagaaaaaaaatggcttttggatagtcttagaaaggctggaaaaaggcaagtcacttattaagacagatagaacttgtaattgaaagaatacatatatcccatgtaaaaggaataacaaggaaggaaatctcagtctcatggagtaaacagtagaaagataacacaatgtgctaatggtaaacccagaggtacacatcgaggtttatgagaaaacagagcagtactagctaagtttagagaaatttttatagaaaggctggatccaggagattagagacagtaattaatatatcatgatgagtgagaatccaatagtgttcaggaacctttagggggaacactctaaaagtactgatggtgaaatgtataacataagaaaataaccacaattatcatgggatagcactttgaatttcgtaaatgtaaaatatttgagctttgggaaagaagagctgtctggaaattgattaataatgtaatgatcacattacttaattaaaataataatgcctgtgtctggaaagcaaaaggctaacacccaaaccctagaataattaagttagtatatggtttggcttggcaggaagagctatgatttatagtcagcacaaatctgcagactagctagctaaactctgtttaaaatagtatgagacaaataatggcacatacattcataatatttttaccaactacataatgactcatttgtagttgtaacatagatattcatgggtagttgtttttatactaaaacactagcaattagagagtccctcctttaagggctagaatcagttgtttggtaccatttggcctttgttacaaatcacataaggtactgaggtttgaaatttgaagaacaagtttcataaagagcaagatttttacagaaattctccctcatcccatggtagatctgatttctcagatttattaacaaaaataatgaatccttatcctcaagcttcttacagccatttttctgatggattatttatgccattgagctctgctctattacccatccctacctatcacttcacaggattccttaaaagtttggcaaataatttagataccttttatagtcacatgcagttaactacattcctgactgtaatctgagatcaagaagccattacttgacatttggccatgttataagctatatttctaggtagtgtaataatcgtatttgaaataattactatataccagacattccacatgtagaataagtttaattttctatatacctccccatttatattccattgtcattaagctaatttatttcctcatatttcacttatcctttaggaatagtcataagggtgggtaaattatagggtagactagaagatttacaatgaatctttaacaggaaatgaactaaaaagctaaacacatcaaggcgattgtgggaagaatgaggggaggagggtagcggaagcagaagatatgtgtcacagcttattttctctctatactagaaatgttgagttaaatcctcatattccatgagcttttgccctgttccctttaagggcttttacagaataggttaatagaaagggctcgtgagacgatgtcagttcctatgtggcatggaatgtcttaagatgctttcactgggtgctggggaaggatgtacaactcaactcaggatctgactggcacctttgctggcatatcaccaaggcttcaggtaaagggaccctgtgtaacagccggagagcagacctggtaccagggtcaggaaaggaagtggagtctgcagcaagcgtcagggccttgttgggccaaatcattaggaaagaccaccagttactgatgcaactgagagaaaacaggttgaaagtgccccatgtgcagagtttctcaacaaatactataaatagatttaggaatggtattaggtaaagttacatcttcaccttggaagataccaacacactgtcaaaaactaaaacacacgttagtggagaaatttactgcacaatttactgagaggataaaaaatcaggagtttttaaacccctctctagaaggagagggagtccatggtggttatatttactacattttcacacgctagataggaaggattgagtccatgactggacttgtagttggttaaaacaagcctggattttggtgattatgaatttgttttaacctggctcaagaaggtctagggtcccagagttactcagacttcatagtttcttaacaatttcgggaggttaaagctagctggcatgaaacataacagttttgatatgttgtaggcaaacgctactgtaagtgaaaaactttcttctacatgagacacatccaagacaatgacccctcaaccacacagtgccatgaggtaacatcagctcctacctccccattcttacatcctgtttggaaagaaacaagaggaaaaatgtgaaagaatgattcttccaaaagaaatggagttatctaaaaaaagtgtttaaattatttggtgagattaggcttattatattatgctaatattgctttttattttttacccaaggaggtgaaaagatgttcagagaaagctaagaccaatagactatgaggaagctatgtctctttcgtgtatctgagagcagtgtgaaaaaatgtgtgaccttgcaacataaatgtcatattttattctcaagacaagcttgcatgactatttccattttataaaatacaagcctgatgtttggagccattaaaggacttgtccaaggtcacacacttagtcggataaagatttgggggttgtaacacaaatttgtctgccttcaaatccatgttctttctaaaacaccaaaatttcttttctgaagagagttaatccaaggtcacatcatcattgcctcagagtagcaagaataggtactcttatgaaattatatttgaaaaaaatagaaagatgttgtgttcttttcattcaattatttaaaaattatggagtctgtaattcaaccatcttttagttttctccccatagccaattcttttctccattcctcccaattatttctatagaggaattgcctgttgattaaagtacctaatttctttaatgacacatataaaagatacagatgttaacctagttcgccataaataaataccaggtacatgcagaatttctcctttcctaccttcaaaaggaataaaaacacaataataaaaccaataatgagaacccagtagccaataagaagtaatttcattgaacaaaaagtctatgtcaaatagtgttttataattcttacatgcatgatcttataaaaatctctattctaaaaggctggtcctattttacccatttagagatgagagaactgagactgagtggttaagtattttcaaccagaccatagagctctctggcagtagagcatggatttgtatagttttgaatgattccctatttattttctttaaaccatcaaattctcagtttttggtagccaagaggaaaaaatgtaccctttccctgtacgtaatgaactggcttatttctgataaacttatacttagtaggtgagacattgtggactaatatatggcactagattcaattttaattctgatccttgtaggaaaagatctctttgcagtgtgtagagtcaaggggttgaactcttagtggaatttgaacttaatggttactacccttcaagaactaattttattgttaacttttttttacattatacaacttttctttagtataaaattttgcatttggacctttatttgcagacttgtatttgtcatcttgttttgcagtattaattaggatagttttctcttgattctttctaatatgctaagtaagtattttctgtgtaatacaacctgtcttcaaactacacctgtaggtgttggcttatctataagatcattggaaatttaatcaaatttcattatatcttgcagtgtcttctgaaaaatgacctcaacaaaatttgctatctacctatttactaacataaatgaggaaaccaaaaaggtcaacggtgaggcaggaaggtttcagttcagtggagaaaagaaaatcttgatgaaatgtcattaacttccatatttggaataagctataaaaggtgtggaatctccattctttcaatccgcagtcagtgttgggcagtcctccctcaaggtttgggctttactgaattggaagtcctcctagctgacatagctgttacaatatttagagtatttagagaatgataccatgagaagtttctgatttatattattttttaaatttaatgaaagtataacagcagatattatatatatgtataatttttttgaaaaatgaaaattctggtactacatacactagatgaaaaaggaatttgtctagttctacacattatcaagtcattttttgcctaaacacattcaccaagatggattctaaaaaacactacaaatcagtttttttaagtggtaagaggtatattttctagaaaaatataaaatggtttccaattgtagctatttaagaatttcaccataaatacttcatcaaattcttttgctctgtgatgatttaagaccttgacaaagtatacattgaccactttttatttttgccaagtttagctctatgtctgaagggcagatgcgataaattggtcatacattatctcatttgcagtctgagttttatgagctcccataaaacaattaccatatacacattttacaataaatgagcaaacaaagcggctgcaaacaatatggaaaagtcaataattaatttcagatttccaaatgtaacagagacaagggagctttctcttcttctcaaaagggaaggtttctttgttaggaatatgcaagcatgttaattcattactgtgtggtttctctttttccaaagcttgtcgaaggtctaatttatgtgcaagactgaaagctgtttaaacggataatatgcctccttcatgagaaataccacccctttatgctccattaagttcagacgttgactctataagctacgtaccaattatttctttccagaaacagcaacgtagtttttttctgcaagggacaacagattattgtaggcggctattaatctccacatagttcacaaaatacacaggacactagggagaaaacaatcacgttgctattttaacatttgcaaaatgctatgtggagaggaaataaaaagaagatgcttgtctgattgcaacactcctttattatttcaaatctcccaaagatagaaaaactcttaataatgacctgctgatgttgaagcatctctgtgatagacacagaaatgagtctttatctggttgatctttgttttctccaacatgtatggctgacaactgcacaatccaactgcatgagacggttggatgtgagagtgagcaaaaatgcctattaaaatgctaaaataaattcttatacaacaacagcattgttgagtgcaatgataatggaacaattcgcagagtaaaaaccagaaaaatataccactacttcagtataacctgctgtaggttagaatttaatatgatggcactgaattatttttaggggagtgaattaccctaagtagcagagctgtttacaaaactattgacactgatactagcccatgtatcaaaatccaaggattattttaataatgagaagtcaatatcttattgttaaaaatgtatgactttatccagtcaaaagtatgtaagtgcctacatttaacttacatccaacaagtatttattgagcacttattatttgtcagaaaccatgctaagtagcaacaatagaaagaagatgggagagaaatacctctgctacggcatgcaatcaagtggaaggctgatattttaatctaaactttttttaatgtattgaggtggctttttcccccaagcattcatttttgttacacacacacacacacacacacacacacacgcacgcacacacagattatgtatatgcatatatatgcatatatttattttaaaaaattaacagtctttatgtttctgaatgggaattttgctccattccaaacaaatagggaaagttttggctgagttggtccacacatcaaagggtgacttaagtcagttaatacattctatttctccagaaactgcatcaagaatgggtatgtaaggcaatcacagcccatgagatactggcaaatattaatggaagctttcgggaaaacaaacaaaaatccacactgtctcctttgtaggagttaccagagaaaactctgactgttttcccaaacctccttatgtgaaaatgtgaacactaaagccgccactgccagaggcatgttggggctccccttatctgtggtttatgacggctgatttgacaatcaattctgcacgtggtagcttgaaactgaccatggtagaagaatttacatctcagaaattgcagatgatacaaataaagggtctttaagttttttcttccctttttttaagggaggtgcagatagccagcttactctgagtccatagtgtggagtcatatggaaacttagtgtgagaccagcagagagtcatgagaaattaggtcttgataccgtaagttgaactaccagatcaagctttagtagaaacctgccctaggtctggagttttcatttaatgtgagcatataacttcttcaaaaaataaacagtttcatgaacaatgtacattattttttgaaggtagaatactaaaattggcattacttcaagagaattcttaaaagcaaattgaggttacagaaaaagacagtatgtgtactgggaatcttaagagaacaattgacagttttgaaaatgtaaatctgcctctcaagatacatctggtggacaggcacttagggggttgataatttggaaaaagcagtttagttgttgaaggcatgtgttgcctacagtggtaaaggttaagttgttaaaatgtggtattgacctgtgcactgattccaattataaaatttactccagtcaaatttgcagtgtacattccagtaaaattaagtgttgccccagtaaaatttgtaaatccacatatgccattctacaggaataactagctaactagccactgagcttatgaacagagacaaaatagaagaaaattccaaaataacagtgtggtcaaattagaatttctgttttaattaacggggaagtagtggaggcatataatgctattgaggcagaaataaaagtgtagtgggtcttaacaccaaagaaataaattctacaatattttatctaatgtattcaatgtcaaaaggaaaggaattatacttaaattatgatacaaccataaattattaatggagaaatattggtccacattttaaagctaatttttatacaaatatactgacaatattaagaaagcttgatcttaataatttaataaactcctgacaggttttgagcacctttgtaagtactatgctttctaattttcatgaaatctccatggacaagggtctgatctactccatttattaagtaggaaactgaacttccagaaggaaatgttactttttcaagcttatatgtcctatgagggcaaaagtttgggtccaactctaatgcctatactttgctgaattagatcacatcaattatacattttgatgcatatttcatcttagcccaatcaaatcaaagtgagataaaaattaaagaaaaaacatattttaagttttgtttagataaaagaaaacatgaatcagtgggcaagccatgggacagttgaactaactctcacacatatcgaagtagagttctaaaacagcatttgatgataaaggttagcataaatctggaagctgttcctctgacctgaataggtgcttagagaatattagcaagctagagaaaggcctaaatatgtgtcgagactcatccaatctttcaggtgtgggaaaattgagttttttattaaggtgaaataaccaatgtctatctcacagcatcaaacaaatgacttagagagacaaaggaatttggaaaaacagctttgtctgtcccatcaaaatagctagtcttttaaagtaataactgtgtaaccttggggaagttagttaccctttagaaacctaaggttttgcaactgagacatgggaaaaaatatatacacatacacattataaggttcttgtgagggttaaatgagatgataatatgttaccaaaaagtaccttatatttattaaatgtaagcattcattaaatgttagttgttattgatgttatttttgttacaaataaaagtgttcttcctttctcatttagtaattataaaacattgcacaattcactggatctctttaagccttagtttatttataaagatggctctcgtatagtatcatgttaatcttttaacgttgctttgagggttaaactgtaaaatgcatataaaagtacaataagtcctcacttgatattgtcaacaagttcttagaaaatactttaaaatctttgaataatattatttgtttcaaaattgtttcattctaaacttgagcagaaaaaatactggttttattatgcttcttttgcttaaagtcagtttctaagaacctatcaacaaagttaagtgaggacttactgtattttagaaaatataataaattaaaagaagtgatatattaacatcctcactagaaaaatccactgggtcatctcactccacatctcgttagcctctgtagcattagagaggaagactaccttttgcaaaatagtatcattcacttttttctcaatgccatttctgcacttctctctgttcctgtctgaccagctctttttcattttctttacagaatgcaatatctctttttacctcataattgttaaatgttccacagggctcctcttaatcctcttctcattctactgaatcttaactactcctatgactttaacgtctaaatctctatctatcgcctagccctagaactacaactattctaatcttaaaatgagttttcccaaatggggcttgacaatgacaaaatgattagtgatcttcaaagtatattggataaactttataaagctatatgaaacactattattccactagatattgatatagaagtaattgagctgcaatatcagatgacattaaaatgagtgtttatcaccattcttggctgaaggtttctggtaagaaataagtagcctctaaggacaaactaagcaaatccagcccagttaagttatgatagagatcattctggaatttatagcatctttctcttcctcattcatttgcttcttcaaaaaatatttatttagcactaattatgtccggaatactaagatttttttataaggaaagaggagaaatgataatagggcatgaagaagattattgaaactgttccttgaactagctttaaatttggggtttactatagtgagaattacactagaaaactgagtccctttataagtactccatttgataatcttgcttctaattttaaatcaatctgaaagaaaaaagaaaaaattaactccatcaggtggaaattatatataaacctgaattgaagaacagattttcttttaaattggaaaataattcttctttggaagttaattcctttctacttagaaactggtagttttatgtaagataagaaatgcagaaaaattagattgatatacaaataactggccagtctttgttttctgatacactagataagtattttatgtatttaaggaattaaaaggtggtttacaaataagaaaaacgtgcctcattttaggctgtaaaactccccagccagaaaagacaatagaaatcacttcacagaagccaaacaacctgatttattcaaattatgaattccaaatgaacgagaatgcttattcttgagaaaatacaaacgtggaatttctatattttcgatatgaatatgacattgagactgcttgtaatttctgttagcaatgggtaatatactgcaaagaaagagaaataggttattttttaaaaagaacccactgaaaaaaaatatgaacaaaaaacctagggaaattaaagatagaaaataagctttattgcttaaggaataagcatgggagactgggaaattattagtatggggaaaaattgaggataagagataaagccaaagtcatagctaattattagttgatttggaatcaataaaatttccatgtgtaattttttggttgctgaaaaccttagttataacatttggtcttatatttaatttaatcttcataattctgtgaagatagtatttccaattctcgtatatgaagataaaaagccaggtttatgaatgttacaatgtttgctcatgtcacagtgttggtcagcagcagaagtgagatataaacccagatctgtctgagccccaagcctgtgttctttccactttcctatgctcatcctattccctctctacagagtgaagcaacattattataaggttctatataatgcaatgtgatttaacactaaccggtgattttcaacttatggaagttaattttgtgctaatccatttaaagtgactaactccatcttccccatggcccacaccacgtgttagtgggacagatggtgtgaactgaggtcattgaagaataatactgattgattcacgtggggattatcaagatgttatgacctaaaagaaaaatcagtctatgtttaacaaattttatgagcataataaaatataacttgtatactcagatatttttcttaaatgcatttatgaaaatgtataatttttatctttataattagcatgctgagataatactaggatcattttaaagataggtttttcatatatagaatattagcatactaataggctttatagcataaaaagcatattaacgtagttaattcacacactggacgagcatattcatttagtttctgtaatatggtaagcattgagttaggtggggtatatcagttaatgaaacaaagcccctgttctggcagagctcagagtctaattacacaagaaaatgaattattataactgagagaaaggccataagttacaagaagctggttttagaacagcgcaagaacttcgcttatactggaaacagaaggaagtttctcataatagaaataaatttcagctgagatctgaaaaattaggcataactaaggtaaagaattgtgacagaacattccagataaaggaggaagtatgtgcaaaggcccagagggaatacagttaattcaagaaactgaaagaaacttgaattgagtggaggcagagaacaaaaagtaaccctagactacacacaggagaggttaaagattttgatctttggcctaagaatagagagaattgattgaaagagtttttgcagcagctgatattatcagatgtaggtttgaaaaattttctcaagtttcaggatacaagacatttaagggtaccagagtgtatatagaaaaaccagtaggcttttgagcagtagtcaaggccagagaatggtatatgggacccaaggtatggaagtggtggccatgagactagatgaataaaatttggattttgaactattacatgggcctttgtactttaactagtgaaattaggctcttctgtgtctgaagtgagttgatgaagtacggattacactgaagatttttccaggaaagcaaggaaaaaaatgcctctactgtgtatatttgactggcagtcaaatgggatggagaaagaaggaagctgcttctcattgtactctatgacaggtgaccagtaaagggccacacacagagataaataacactgaaagaggaccaggtttaggaaggcagactcagcagcactgtaatatagtggttcataaatgagtctttggacccagcatgcatgggtttaactactgggtctgagatgtattaactgtatgaacgtggacaatttatttatacctattattccccgtttctctcatctataaaaatggagaagattgtgatggtaactacttacctgaaacattatatggcccatggcaagaaattagtaagttgctattataagccatttctggatatgttgaattttaggtcattttaattatacaaaaaggcatggtgagtaaatttttagatatatacatctgagttcagaggaaaggtctggactgcagataaactgaggagtcaatagtgtttagatggtaattgaaatgggactaaatgagattgactccctgagaaaacatagtgaaaacagaaaaggaaataaaaccgctttgaagaacactattgtttaatagctgggtaggagaaggtgagccttttaagaagattgagaaaaagtggccagatggatagtaagaaaaccaaagaagcttgtatcatgcgcactaagagaaagaagattgtgaataaaagagaaatggttactactgtccaatgtaagatcatgtaagacaaacattgcaatatgactattgattttagttacttgacgatcatcatttaaggtcaataatgaccttagcaatggtggtttatatggagttataggatcagatgccagaacaggggaaactgaaaaataatattgaggtaaataaatgaaaacaaaaagatatcgctcttttaagtttaattgaagggagaggagggaagtagaatggttatttaggtggaattgaggaagaactttactaatgaaaaaaactgatagtttcttttaagacaatgggaaaaacctcaaattgattctatttggttaatgggccacatatagttccaattagacaaattaaggattgacagtcactaaggagtaaaataggtcatcagagtgtccatatcgaaaagacagaatctcaatagtgatcttacattatcaatttggtcagatggtgatccctttggatattacacagtaggacaagatacacacatctgtcacattccaacatcttcataggtcaagatcccagtcaccagaagtacattagactacccttattccttacacaaaagtatacatgacaaccctgattccttgctttcttcataaatttccactttcttctaccccttcctttattggttaatcttgacctcataccccattgttaacaatgactcagtcttcatttcttttggccttcaggacctccggtcctttagtaatttatttctaaattactaaactaaattatttagtaatttagtttcatactttggcatttcctgaaagatgggcaatctattgttatatatttacagagtgtctactgtgtactcaatgtcttctaggcactaggatacagcagtgaacaacaacaacaacagcaaaacaaaatccaagccctcaagaaacttactccttggtgagacagaaagataaatgtatgtctgtatatctaagtgcttgaataaataattaaagatcacacagtaggtcaaatttgtacacttttatgagtgattctatgtcactctatataggaactttagaaaaattttccccagaatttgcccagcaggaattatgctatattttgaatatgaatgtgttaaattcctcaaattacatagcacattatcaaatgtttacagataagtgatacctaattttacaggtgacattggagcatcttgcatggtgtttggaatatacttatgattgatttgtatcatttgttatacttccaggactacgtgtctttccccaggactatatgccgttccctttccaggactatgtgtctttccgcaggactatatgccattccccaagtgccattcgggtagtctgacctcttaccagtcttgggttaatcagctttgagatgggcataatgataaatcctgaaaaaatatttttaatagtttttgtttgtctgctgctgctctctaaatagtaatgggtaagtttctgttttaagtcatgtgttatcctgaagccagtgtatagtggagtccatctcatgctactaggactgataatgtatttttagatcttcagcaaccttaaacgattgtgagtggagaatgggaagagattgggggtgataactgtgtaagcataaatccaatgtgtgagttgcttgagtgtaccagtacgtcagcgtataattacagagtgatgagcacaaaggaaacactaaatattgattttctacatatgagtcttgatgctggatcttgctgccttttacctaagttcttctcatttattctcaccacctccctctagcacttagtaatgggatagttgaagccataggtatctccagaaatagagtatgatttattcatctactttttcatttcacacattttaacggtcgcctattgggcaatgtgtaattttcatgctattcggaattcaaatatcgaaggcacatttcatgtattcaaatttattacaatttagtacatacaggaaaataaaaggttttaatacatagtgataaatgagaatgtagcataatagttggcagtctaagctctggagtccaacacagctaggctgggagtctaaattccatcacttttgactacatagccttgggtagtcatttaacatctgtgggataccaatagtaattgagacccaaagatgctgtaaatagtagataaaatgactcagctgtttatcacagtacctggcatataatatgtcagcctgcatttttgttgacattggtgtttatttttgtataagaatggcatacacgtagtgatactggacaagggaaagagcactggagatgaaacatcccagaagactttctgaaatattaacaggacatgtcttgacacttgaaagatgaatatggattaggaaaggcagaaaaggcagaggaggaaaggacaaaggttagtgcaaaggctggaagtacataatgagcatttgcaggcttcaagaaattccaggtatctggagagaaagtgtgactgtggaaaagtaagactgtgaagggccttgcgtgtcttagggtactaaaaagcaattcacatttcttcttttcatggatcttagttttgtgtgaaaacccagtgtccttccaatgaattaatatgttccgttcctaatgtcaacaatccagtgattatgctgctttgtagtaaaaataaaaacaacccaaaatatttcagtgaaataaatttgaaatcattctatatatatcattgtactaatgaaaagagttagaattcagctcatatataagtctagcttttctaatgcttttgttttaagacctgtgttttaggttcggggctacatgtgcaggtttgttacataggtaaactcatgtcacaggggtttgatgtatgaattattttctcacccaggtacgaagccttgtattcaatggttatttttctgctcctcttcctcctcccactgtccatcctctgttaggctccagtgcttgttgttcctctctttgtgtctatgggttgtcatcatttagctcccacatataagtgagattatgcagtatttagttgctgcgttagtttgctgaggataatggcctctagctcactctgtgttcctgcaaaggacatgatctcatgctttattatggctgattatcccatagtgtatatgtgccacatattcgttatatagtcttccatcaatggacatttaggttgattccatgtctttgctatataatgcttttttttttaatgaagctggaggtaagagatgtctctctctctctctcttagaaatgacacaatgattaccctcttcattgatgctctacttaattctgtgaaggtagagaagtgagcaagatcttgcttgagaagtgggcaataaattcttgttcacttctttagctgagccatctttatctgtctttgtatcttttcatgcctcatcctttctaaatacgtaggtaaggcaactggtgctgctctaaaaatgtgggagtggagggaaatccagttatgacccatgtgtatagagctttccttctggcttgctcttctcctgcacctactctaagcaaaagggcttcctccatggatctagtttagctcacccctgggaatattctggagtgtggagctaaagtgtagatagaaataccatgttcttttattgtccatttaactgtatgctatgtttttccagtggcaacagcaggggaatctgcctggggctctgtttcagggcccctgcttcagggttcctgtgtctgtaccatctgtctccttatcaaatatcaggttggtgcagaagaagtaattgctgcaccaacctaatgtaacagtgggcaccaccgttttgacttgatctctaaatgattacctcagtgcttattgtgaggtgtggatgagttaccatatatgaaatggcctaggaaattgtcttggatatggttggtaatgtgcattcattctgacctagcccattgtgaaagataaagggaaagaataaacagagattgagggtttccctctcttttaaccactgtgaatacagaggaaaaatgaatgcccagatatacttttttacaccatcttcattggatttatatgaaaagtacaagcccatcaataaataataaaacacacattcccaactaaaaattttggtattttaggtctaagttaacaatttattttttcaagatgaaaaggtcccattctaaggtcttttttttttttttttttagatttattcagggagaaataaacatctctttactgaaagcaaacaacaacaaaaacatatcttggggtcaataaggttaatttttttggtagaatattttttttcttgagggatacacaatggaggtgattatgttggaagcgaggaacaggagaggctgagttcagtaagttcaacaagcaatagctattgcttattctacaatgttgggaaatttggggactttacctttttctcagattttgattatctctttgtcaagaagtgaagttatgtctggaatgaatgttaacaatatcagttgaggctaaagaaagcatctattattaccagcctgtttcaaaacaggattttatcaatcacttttggcataactggcattctattgtagtctttttcctccagaattcactgaaaacaagtaattccatgaatctgtgtgcttgcttctcttgtttttaaaagcttccttcagtgaatcatttggtaactactttttaaaattaatgtacactcaaaatattttttctgtattaattaaacaagataaaaaacctaggcttgataggatatggctctccaaagattctctttaaggataaaagaataaataaaataacaaagaacaaaatagttgggcaaattcattttcagtcaacaactatcatcacttatgctacaaatctgtgtgtctgtttctgggtattctccagaaactctaagccacagagttgactgtcttctgtgtgacatctccaccagcacttatcctctctatatctcaaagtcagcaggatcaaaattgaagcccttatcaatgaccagacttcctcctcttctaggatctgacctattggatagcagaacatttaccctaacgtccatctaaaaaatcaattttttctcatttatgcattaattctagtaatatttattgtgcaactacagtgtgctagacatggtctaggtgctgatgctattttagagaatatgtctgacaacattttttcccttattctaatgagggacagcaataaaatgaacaaatatgcaaataatatcatgtcaggtaataatagatgctataaataaaatgactagaataaaataaactcctttggtcttatagtcagtgacattttgtaacttgtttcttcttccagtatagtcttctgaaattaatctttagtgagtcttcagagatattttagtgagctgaaagacagaaactagttaaggtcatcagactggaattcattaattgtttcctttctatcagtgatactgtcctctcagttttgttgagtattttgttcagtctcttattcttaattctctagcagcctctgtttcttttatcttctctcacatactgcagatagaatttttcttctgcttagcctatgtggtagctgccttccagtagcctcagactcattataacatcagtcacctcaagtgagatggatcttggcagtggtgtgttgatgaaaaaaaaaaaaagcctgatttttggcatttctaaatttccatgtgtaaatacttctatcatggccaatcttcaggctaccagaatgacagcacagaacatgcagctgggaaaattttatgccgtacactctcacaagcctgtatcaacactctgagccagcacaccactggctcttgggcaaaagataaattgaccaagttttagtcaaggtttcctatcttaacaaaataaatgtactagggcagtataatcattttatataaaatagcttcctaggaaatctaatgtgctgttctcagatctgggcagtgatggttgaggatgggaagggacttcctgtgaacgtgtaaaaccataggactacctctccaggtcatgtgatttgtccattatggacttattacatggaatttctttcctctttctcctatcaattttcctagtgtctatggggtttttaaaacacggccacaaatgctctgaactgctctcacaaagtggtagattatgtgttggaatcaggacgtgcttgtgactactttgacaatgaccagtagagttcagtggaagtgacaatatgtgacttctgagtccaggtcataaaagacttggactgaagtcctgctctctgctgcattcttgcaaacctgagaatcatatgagaagtctgactaccctgagattgtcatgttgtgaagaagtcctcctcacacggaatggccagatatagaaactctggttggtaatcctagatgagtccctcactctcaacccccaaccacagagaaagtttcaggcacatgagtgaagaagacaccagatggatgtaacacagagctctttatgaatcacttccaggcatgaattttcctagctaaggccacagaccttgtagagcagaaatggaaaatctcccctatgccctattttggattcctgaaccatagaattcatgaacttaataaaatgattgttgttttatttcactacatttgacatggttcgttccaaagcaaaagataactggaagactcaatttttccaggctcaggttgccataatggagatgtgttcatgaataaagttcctggcactccactcataaagctggtgagaaaatacaagattgtactgctgaggttaggacaaaaaactcatagtgatgcctcccagaaagttatgaaaaatcaaatacaacattcctaaagagtttgaaaaattcatttgggacagggtctcttgcaaaagtatttattggggaagataagatcttacaagtgagaatccaggaagtaggtgattttagaataaaaatagataattgtatgatggaaatggaggtcacttcacaaaaactttacagatagcacatcaaaaatgggacccatgtatatccataagagtataccaacaaagctcagtttaaaccaacaaagctcagagttttaggtgctcagtttcctggatcatgtatcatccctctgtatttgaatttagcttatagaataggggaaagatgatgtatatttccattttttcagcagatgggcataagtgctgtatgcattattctgaggaagaatatttcagttaactattgcagtaatatttctgcataacagaccactctaaaactaagtgattttaaatgacaataatttattatcatgggtctgctttaggctgtggaggctggaggatagctcacctggctggtctctgctaggcaactttgctccatgtatttcttactcctcacatggaatttgctgcattgttggggcatatttttagggtgatgagaaaggtgcataaagttaagcagaaatctgcaaggtttcttaaggccatatctcaaaggtgtcatgctttcccttctactctactccattgacaagttacatggccaagcccaataatgtgccatggaaagggtgcatatgatcatgaggctactaatttgatctaccacagaagaattgcagtgtctaacagagatctagtttagcagattaaattccaaaaactgacaagatggctcggtacgggcatttagataaaagctcagccgtgtggacataagctgtgttgtagctgtttacattgcctaaatctcaggaatatttagattaagcttattgctgactctattctagatggtctggttcagggttcagatgcaaaacattttattaaaggagcaggtcaacagttaggtgaagatacggctgtttggtgtgcacccctgatgccacaaccgcctctgtaaaagacagatgttcacctagcaattttcaactcatttttattccactagattttatattgaatcttcttcatataaataatgtatttttcaacaaacaaactgataaagtaatctaccatagttaaagtgagtgttggacatctatttttattgtttgtgcagtaaaaatagatttgtgtccataccgtactctagtgtggctttttaaaacttctaggtcttataagtatgcttgaaaaacatagttcctttcgctcattgaatctttcctaattatattagcacttactattgaattcctatttctcttatagtacatatcacatattttggtatttcagtgtctttttgaaatattgaggtaaaatttacatagaaatgcacagatcttaagtgtgcaattctatgatttttgacaaatgtgtatagatttgtaactatgcctcagtgaagacatagaacatttgcacttacctacttggaaattttctttgcaccccttccaatcttcattcccacaccaaggcagcactggtctgacttccatcaccataggttggttttgcctgttaactgaactttatttaaattcaatcatggattacatgctcttctatgcctagtttcttttgtggatcaaaatatttttgagattcatacatgttattgtgtatgtcagttgtttattttttggcctgtttattttttaaaaattctgagtagtatttaatggcatgaatgtaccacaagttgaatattcatactattgatgggcatttggatgattgatagtttgtagctattaggaatgaagctgatataaatatttttgtatatgtatttttctggacatacatttttacttatgttgggtcaatatctaaataagcagatttctgggtcatgggatacattcatgacaccagctgcaaattttattctagagtttttgtataattgtgcacatctatcaggaaaatatcctatttgtatcagtttcttaacagatctgatgttggcattaatgatcttttaaatattaaccattctagtaaagtagtgtctcattgtggttttaatttttcatttcactggaattaatgatgttgagcaccttttctagtactcattggactttcacatattttcttttatgaagtgtctatacaagccatctgttttcttctattctttatctccatctgttttcttattgagttgtttgtctttttcttagtgaattgtaagagttccttatattatctggataaaactcccttgtcagatgtacatattgaaagtatttttcccaattccatgcaccgcatttttagttttactaatgctcataatttcttaccagaagttttagtgtcaatagaatccaatccagcattctccacatgtgttttgttacccatttaagaaatatttgtctatttcaaggtggcaaggaaaacctagctaggtctttttctagaagctatgcatttagctttatgtttggttttcttcttcttaaataaatttttgggtgtggtgtgaggtagtcaaatgtatttctttccacatatttattttgatgcatcagcatcatttattgaaaagattttctcagcgtattgtcttggcaactgagggacatcatttgacaatatatatgtgagtgcatttctgaattttctattatgctttattgatctatttgtctattttaaaatcaataaaatacttgtttggtaggtgtggttttacatgaagtctttaaatatgatagagtgagttctccaacttcgtgcattttgaagaatcttggattcattttgcatcttcatattagtttgtagaccatgcttgtctatttctgcaaaacatcttttttaagttttatttggaatatattgaatatatgaataaattgagagataattgacattttaacaatgttgagtcttccaatcaatgaatagagcatgcctttccatttatttagtttttaaaaaattatgagttagtttgtaggttttggacagaaatcctgataagttattgataaatggctcatgttttctgatattattggaaataatatttaaaaacttatccaattttttgctaattatatgtaaaaatatattttaaaattgtgaatttatagattacagtcttgttaagtttacttttaagttttcttagttgttctgtagatttcttaggatgttctaagtagctaattatgtaatctgctatggagactattttaattttctttcatatttacttgtcttttatttatttatcttgctttactttcctggttaggatttccaagacagtgtttattagaagtggcaagagcagaaattgttgaattgtttcattcttaatatctcagtattaagtctgatgttagccctgtatttattgctgcgctttttcaggttgagggtttcctttattcctagtttgttaaaaatttaaaaataaaggtgcaaaaatgttgtcaaattccctttttaaatgtatttaattacttttaaaatttttattaaagttgtaaaataaattggctgatttttgaatgttgctccaactttacatatctgagaaagagctcatttcatgtgttagtagaccttatttattacttagtttgttaattttttttttttttttgagatggagtctggctctgttgcccacgatggagtgcagtggcacgatctcagctcactgcaagctccgcctcccgggttcacgccattctcctgcctcagcctcccgagtagctgggactacaggcgcccgctaccacgcccagctaattttttgtatttttagtagagaagtggtttcaccgtgttggccaggatggtctcgatctcttgacctcgtgatccacccgcgtcggcctcccaaagtgctgggattacaggcgtgagccactgcgcccggcaaatatttgttttttatgtattttttttttcaacttagttcaggggtacatgtgcaggatatgcaggtttgttacataagtaaacaagtgccatggtggtttgctgcagataatcccatcactttagtattaagcccagcatcaattagctattcttcctgatgctctctctccccctaccccaacccagacagaccccagtgtgtgttactacagtgtaataccattattcaactatcgtttatgctattgtcatattaccatgtgtgttagaaatttccataacatgttattgtcttagtctgtttggacttctataacaaaataccttaaactaggtagctaataaataacagaaatttatttctcccttttctggaggatgggaagtcaaagatcaaggcactggcagatttcctgtctggtgagggcctgcttctcctatatgacactcttcccattgtgtctcacatggtggaaggggcaaacaagctctctggcctcttttgtaaaacactaatgctgttaatggtggccccaccctcatgacctaatcacctactaaaagccccacctcttaatgctattacactcgggattagatttcaacatataattttttggggggttgggggaacagacatgcagaccacagcagttattttgtgctttaaacaaatcttccaattaagagaatatatgctcacatatttatcatttctttttctctataaattcaaatttttttctgagttttattttaaaaggaactgaggaactattgtattttttaatgcaggccagctggcaatgactttctcaactttcacttatttataaacatataggcctaaaaatgcataaaatgaaccaattctataatgttacacataattagtattctttattaagtccttgaaaatattcacattaactgtttcaaagttcttttctatattctgtttttatttattgttttccttcttgattcggcattgcttttctctgctttttctcacatgcggtaactgttatataatggccattgccaaagctatgttgtaagtagtctgaattatgtcatcttcttttaaaagtttttgaactttgttctgaaaaagaaattaacatcccaggagctttttattttttttcattctggcaaacttggttttactttttataagagcaagtatatttttcttttgtctttgttactaatgtgtcctgtgacctaggaaatgacccttacttctaaattctaaccttttcatgtcccaactaaatgcacaaggtgctcattagggtctctttacccttgcagagctgaaactccagtattttctaacattgtgagacctctggtgtctttttcagtcttcatctctgagtattactctgcaagttttcatagtattgacttacatatttgaaacccagacattggcaaaagacatgtcactaactcctgtgaagtcttccatgctgtttacttctagcagctttcccttctctaataccttgcgtacaaattacagtaagttcaatattttcttcttttgctcaagaagattgtgattatttgggggggctctattcctgttctgttgtagaaaagcaagatgtcagaaaactagaatgactgtttgcttttgtgtctctcaatagtcagacagtactgtctgatgtgaagtacctaaaaaagagttgtcttatacactgtgttcatgtttacagttagtggatgtgtacatccagtgtaagttatttcatcatagctagaattgttctttcgtggtttcttacagttttattgtgatttacttttggcttcatagttataatataaactttttaccaaatgggcacgtattttagatacatgtaaaaaatattttccaaacagtaggtgcttaataaatagaagcccagcatattaaacagaagtcaaacaacttttgctgttctttgtccaagagactgtcccacacccatgagctttagcttctcaatacagatttttaaacgacacttaggagtcttggctactataaaacactacttcgtttttttccgtcttgcctcaatatcttgacaatttctaggataatattcttacttacctctttagtccacatgtctcaccacagggacagacgcactcttcacttggcatatcaagtgattactgaaatgtacattttttcagggtaactacattttagtggggattaccagagagaataagaatactaacatttatcccctgcattttttgttagtcctataacaatatagacagttaggttgtattgttcctcttttgcaaagacaatcacaataaataattttcctgggatatagatattgaactgttagaacctatcttccccaaccccctcaactgatttaatttcatctgaactttagtaatgttatttttaaaatataaataatactaccagcctcacagggtgatttagaacattaaacattataagtgcaaagtttcagtcagatatttgattagtttcttcctctctagaaagttgtcttgagcgcccagtatatgcatagttagagtgagatttgaatcagtatttcatcagtgcctcttactttatagcctgcactctttgcaaggtaccacttaaaaaaatttttttcaggtaattcttttctattattattattatattttaagttctagggtacatgtgcacaatgtgctggtttgtcacacatgtatacatgtgccatgttggtgtgctgaacccattaactcgtcatttacattaggtatatctcctaatgctatccctccccacttcccccaccccacaacaggccccggtgtgtgatgttccccttcctgtgtccaagtgttctcattgttcaattcccacctgtcagtgagaacatgcggtgtttggttttttgtcgttgtgatagtttgctgagaatgatggtttccagcttcatccatatccctacaaaggacatgaactcatccatttttatggctgcataatattccatggtgtatatgtgtcacattttctttttttttttctttttttttttttttattatactttaagttttagggaacatgtgcacattgtgcaggttagttacatatgtatacatgtgccatgctggtgcactgcacccaccagctcgtcatctagcattaggtatatctcccaatgctatcccccccccctccccccaccccaccacagtccccagagtgtgatattccccttcctgtgtccatgtgatctcattgttcagttcccacctatgagtgagaatatgcggtgtttggttttttgttcttgcgatagtttactgagaatgatgatttccaatttcattcatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttctggcagcatgatttatagtcatttgggtatatacccagtaatgggatggctgggtcaaatggtatttctagttccagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagacgtgtctgttcatgtccttcgtccactttttgatggggttgtttgtttttttcttataaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgtttttgacatgaagaccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaaaagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctatgttcttttggcttaggattgacttggcgatgcaggctcttttttggttccatatgaactttaaagtagttttttccaattctgtgaagaaaatcattggtagctttatggggatggcattgaatctgtaaattaccttgggcagtatggccattttcacgatactgattcttcctacccatgagcatggaatgttcttccatttgtttgtatcctcttttatttccttgagcagtggtttgtagttctccttgaagaggtccttcacatcccttgtaagttggattcctaggtattttattcctttgaagcaattgtgaatgggagttcactcatgatttggctctctgtttgtctgttgttggtgtataagaatgcttgtgatttttgtacattgattttgtatcctgatactttgctgaagttgcctattagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtttctctgcctggctttggtatcagaatgatgctggcctcataaaatgagttagggaggattccctctttttctgttgattggaatagtttcagaaagaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgttgaggaatttatccatttcttctagattttctagtttatttccatagaggtgtttgtagtattctctgatggtagtttgtatttctgtgggatcggtggtgatatcccctttatcattttttattgcgtctatttgattcttctctctttttttctttattagtcttgctagtggtatatcaattttgttgatcctttcaaaaaaccagctcctggattcattgattttttgaagggttttttgtgtctctatttccttcagttctgctctgatcttagttatatcttgccttctgctagcttttgaatgtgtttgctcttgcttttctagttcttttaattgtgatgttagggtgtcaattttgtatctttcctgctttctcttgtgggcatttagtgctataaatttccctctacacactgctttgaatgtgtcccagagattctggtatgttgtgtctttgttctcattggtttcaaagaacatctttatttctgccttcatttcgtcatgtacccagtagtcattcaggagcaggttgttcagtttccatgtagttgagcggctttgagtgagtttcttaatcctgagttctagtttgattgcactgtggtctgagagatagttagttataatttctgttcttttacatttgctgaggagagctttacttccaagtatgtggtcaattttggaataggtgtggtgtggtgctgaaaagaatgtatattctgttgatttggggtggagagttctgtagatgtctattaggtccacttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctatattgggtgcatatatatttaggatagttagctcttcttgttgaattgatccctttaccattatgtaatggccttctttgtctcttttgatatttgttggtttaaagtctgttttatcagagactaggattgcaacccctgcctttttttgttttccatttgcttggtagatcttcctccatccttttattttgagcctttgtgtgtctctgcacatgagatgggtttcctgaatacagcacactgatgggtcttgactctttatccagtttgccagtctgtgtcttttaattggagaatttagtccatttacatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagtgcttccttcagtagctcttgtaaggcaggcctggtggtgacaaaatctctcagcatctgcttgtctgtaaagtattttatttctccttcacttatgaagcttagtttgtctggatatgaaattctgggttgaaaattcttttctttaagaatgttgaatattggcccccactctcttctggctttagggtttctgctgagagatccgctgtaagtctgatgggcttacctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccctgctagattggggaagttctcctggataatatcctgcagagtgttttccaagttggttccattctccccatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatgggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctgagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatgatgatgtacagatgggtttttggtgtggatgtcctttctatttgttagttttccttctaacagacaggaccctcagctgcaggtctgttggaataccctgccatgtgaggtgtcagtgtgcccctgctggggggtgcctcccagttaggctgctcgggggtcacgggtcagggatccacttgaggaggcagtctgcaagttctcagatctccagctgcgtgctgggagaaccactgctctcttcaaagctgtcagacagggacacttaagtctgcagaggttactgctgtctttttgtttgtctgtgccctgcccccagaggtgaagcctacagaggcaggcaggcctccttgagctgttgtgggctccaggcagttcgagcttcctggctgctttgtttacctaagcaagcctgggcaatggctggcgcccctcccccagcctcgctgctgccttgcagtttgatctcagactgctgtgctagcagtcagagagattccgtgggtgtaggaccctccgaggcaggtgtgggatataatctcgtggttcgcggttttttaagccggtctgaaaagcgcaatattcgggtgggagtgacccgattttccaggtgcgtccgtcacccctttctttgactcggaaagggaactccctgaccccttgcgcttcccaagtgcggcaatgcctcgccctgcttcggctcgcgcacggtgcgcgcacccactggcctgcacccactgtctggcactccctagtgagataaacccggtacctcagaaggaaatgcagaaatcacccatcttctgcgttgctcacgctgggaggtgtagaccggagctgttcctatttggccatcttggctcctccctgtcacattttcttaatccagtctatcattgatggacatttgggttggttccaagtctttgcttttgtgaatagtgcctcaataaacatacatgtgcatgtgtctttatagcagcgtgatttataatcctttgggtatatacccagtaatgggatggctggtatttttcaggtaattcttaactgtaagcataggattaattttcttggccatcattctctgagtcattgaaaacatagtttggtagtcactccaattgagttaaaggattttcagtttcattgggtaaaatcactataattcgaaacaccattattaatagacactctaaagacactcatcaactttttaacacatcgagcctcgtaccattataaaagaagagtcagtttcaaagtttaacaaattttgaatctgtgaccactatttgcatcttatatctatgctcctaacaaaaggcaaccaaattaaatggaggatttattataaggtcactgtcattgtatacttgtatttccgtgtaacctgtgataactatttcttgtgttcactacctctgactgttttaagcgaaagcacacaaggaacgtgttaaaggtcagttcaatattgctatggagtgtgataacatttgtaccttaaagaatgtctaacattgcaactgatttttttctacaactttagaacctttttcattattctaatattacagccctgtttgttgaatgaaggaatgagtgaataaattgcatagcttctcattctgcaaatgcatgataaattgtaattgaggagagaccacttgttctaccagttttgagttaatatagatctgactctgctattttcataatcataattatattatcatagttcccaggaattatatctatgtgaaattataaataatagtattttggtgtaaaaatttagatttctagcccagaaaacaatattaacaaatgaagaaacccattaactactgcatttaaaacttcatgtttaaagaaatgatctattaatatattaacatattttgctgaaatgtgagaagggtcccatagttctccaacagtgttattttagacaatcatcatatataagaaaatctatgaaaaaaaggacagcaaaattacaaataaattagaaaactatgcttgtgagcctggaagcacatatcacatacctgactatgccattaactatctgtactttttataaacataattgttatcttttgtagtctcagaaaattgagttaggtaattttttgcattcctgtttattttctaaaatttccatgactcagagaacactttctctatgcattgtgagctactttggattatacaactaaccaaatggagtttgaaagtataatgaattaggttttctcagttagtgatattcattctaaaatttgcttctattaatttctactcagtagccctttcatattcacccatagatcatttcttaaagttctagaaaaagggggcccaggtaaaaattcatgatttagcttaataaaatattcctcaactttatcctatgcataaataacatgcataatttttgagttacacctcttagattttttttaataaaactaagcctagaatttagccttttatgatttatgataagtctaggtcattccactactaattcttacctttaaagcatcagtgccttttgctatctgctccttgggattcatttattaagaggctgagatgtgaacatctgtccatgttccaacagaacaaatcattccaaataacctttctaacccaaagttcaatggatgaggcagacaatgatttatatttgaggaattttgctttgcttttgcaacaaaagccattcttttactgtactctcaacaactgcttgtattgcattaatcagaccttaattaacatggaagaaaggtgataatttacatttatttcagattgacacattgtactttatttagcaaatgagacctgtcaggcactgccagtgatgcttagattgaagacagagtgtcgaaaatatgtcttccacctgcctgtgcctttgtaggagggagctttcagtatgtttacacagggatcattagatgtacctcatgctaagctttcatgaatctttgaataagaaatgctcaaaggtcatcaggtatgaaatattttataatgacacagtgccgtaaggcatgagaaactgtgatttattctccaaagtaaactcaaaagaggataaaggaaagagaactgcataggactcaaaataacttcagatctatcaaaaacagaagagaggagagctgaaactatgagaatagaagctgaggaaaagtttatttactcagtgtcattgtgcaatttaaagtaagagttggaggacggaagtaaatagacgaccgctgtaactgatcaacttctaagaacaataagtgactatcaaatgtcaggaagagaggagaatttaggaattatgaaaaacagtctgctacgggatgaaaactgttaattaaagaagataagtaatttctcccattcttgcttttgattgggcatataggtaaaggttgaatttgaaatataagtttaagataattgagaagaatgaagcatatagttaaagcccatattctgctttcataattttcttgacttttattagcatatatttcagaccacagtttaaggcaggcagtgaggggaagtcttataggctcccttcttgcatgtttgatgagcctggccacttgagcatcacccagagcatactgtccccatgcaggcatccacatctttgctcatgtggtctcctctgttgaaaggaccactccatccactcgatatggaaaatctgttaccagctttaaagtgtgtcttggatctcccctccacttgggagcccagtaccattgtactcccagagtactttaagtcgttcttatcccactgcttatatacctctgcttacctgtaattcctattcatatttatttccccatggcttggtagaatgtctagtgcaaggaaaaaattttggtagttgctagtcaaattagattaaaattttaatgaaaattcatatttttgtagccagtaaatagtattgttttagggtgaaatcttgtgtatttgctcttttaaatgtagcagttaactggtgcagggatatgcaagtctaccacggagtgtgcattgtggcactatttatatagtttatgtgatgtgtgtataagtttaaaatgttaatgcatgtaaacagtatattctcaaaaattcatcgccatttatatagttttgaaatgtatagactcttcctttttaaaattagtttacattttcattgacataaatcattagaagaaattaaactttttattcactgaaaccatagtttaaatgctgatttttctcttttataatataaaaacttacatatattacttttggtaaactttttaaagttttattttctttgtctagagattaaaagttaataatgcctacctcattttttttttaatttcaaaaggtaaaatagatcctcaaaacctctagcaaattttaattatctgattaaatgtttactatcttctcatcacctttaattaacactctggcaagcacactaatttataggtcaaggggctgaaatttccgtcaattaatggcattgaacaagcctcttaaccactgttaaactcagttacctcatttaaaagtgagagtaattttgttgaaatagtaggtgccactctattaaagagaaataaaagctctttggaggagagggaaatttcttgtttgatatatcctgttaaaattatacagccaaatatagatggaaaagatgttataagtcataatagaatccatgatgccaaatctgcgtaatctcacaacacagcacagaattaataatgatgtggcttgaagtggaagatgtttcttattgctgaagatctgtataaaaaggacattaagtttttttatgttagttatgccaaagaaagcatattatgtatgaattagagtttcaaattctgttttgtgtgtctcagtaggaattagaaaattctcattattatgaatatcttgtttcatggttgtttaatggcagagctgaagtggaaactaggttcctgtccatttccatgtcttaaactatttcgtttaaggtaatacttttcagatttaagaatccagtttcaaattctcttgcaaattttagggtctattttccaattgcttgctgatacctttacagagatttttctgctaaacacaatacaggcatatcttggagatgttgcaggttcacttccagacaattgtgctaaaacaattatcacaataaggcaagtcacacaaatttttgggtttctcagtgtttataaaagttatgtttaccctctgctctattaagtgtgccctagtattatgtataaaaaacaatgtacataccttaacttgaacatacttaattactatgaaaatgttatcaatcatttgagccttcaccgagttgtaatctttttgccagtggagggtcttaccacaacattaatagctgctgactgaatagagtggttgttgaaagctggtgtggctgtgacaatttcttaaaataagacagcaatgaagttttctgcatttatgactctttcacaaaatatttctctgtagcacatgatgctttttgagaacactttactcacagaaattctttcaaaattggaatcaatcctctcaaatcctgccactgctttgtcaactaagttcatgtaatattctaaatcctttgttgttatttcaacaatgttcacagcatctttatcaggacttgattctatttcaagaaaccacttattttctcatctgtaagaagcagctcctcctttgttaaagttttgtcatgagataactactcttaatgtttatattttgacttcctcccataaatcactaatgctcttaatggagtctagaatggtgaatcctttccaggaggttttcaaattagtttgcccagatctgtcagaggaatggttacctgtggcagctctagccttgtgaaacttacctcataaataataagacttgaaattcaaaattactcctggatccatgaactacagaatggatattgtgttagcacataaaaacattactctccatgtacattttcatcagagctcttgagtaaccaggtgccttgtcaatgagcagtgatattttgaaaggaatatatattattttctgagcagtaggtctcaaaagtaggcttaaaatatttagtaaaccatgaagtaaatagatgtgctaatacggctttgttgtttcacctatagagcacaggcagagtagatttagtgtaattatttagggctctatgattttcagaatggtaagtgagcactggcttcaactttaagtcagcagatacattagctcctaacaagagagacttttgaagccaagcattgattctctctctctagctatgaaagctttatatggcattatcttccaatagaaggttgttttgtctacattaaaaatctgttatttagtgtagccacctttgtcaatgatctagatcttccggataacttgctgcagcttctgcatcagcacttgctgcttcgccttgaacttttatgttatgaagagagcatctttccttaaacttcatgaactaaactctgctagcttcaaattgtcttatgcagcttcgtcatctctatcagccttcatagaattaaaaagtgaaggccttctcttaattaggccttggcttaaggggatgttgtggctggtttgatcttcaatccagaaaataaaaactttctcaacatgagcaatagggctgtttcatattttttatgatctgtgtattcactggagaatcacttttaattttattcaagaactttattccatccagagcattgctaatttttcatgttggaagcttagatttcagcctatctcagctttgacaggcgttcctcactaagctaatcatttctagattttgatttaaagtgagagatacgtaagtaacagtcttcttttcacttgaaaaattagagaccattgtagggttataaattggcataatttcaacattgttttttatcacagaatagggaggctcaaggagaagaatagatggtggactgttcggttggtggagcagtaagaacacacatatttatcaattaagttttttgtcttacatgggcacggttactggtgccctaaaaacaattaaaatagttaaataaaaaaaatcactgattacagatcaccataacagatttagtagtaataaaacagttaggaatattgtgagtatcaacaaaatatgacataaagacataaagtgggcatatgatgttggaaaaaattcccccaatagacttgttccatgcagtgttgttacaagccctcaatatcagtaaagtgcaatatagtgaagctcaatgaacaaggtaaacctatgtattaaacgttctgtcaatataccctccaccccatctcattgttgttctgtatactcatttcctattctgttggttacaaatttcttctaaaatttgtttgatttcactctatttccaaaatccatagtatctatttctggaatgttgactgcaggcctctgttttatacgcaatgcctacatggttgttgatgattataacatatacttgctacctctggactttcactaaaaacatcctttccatataacttatccatagaaacatctccccaaactataagacttactgtggcttttcattgcttggaggattagctttaatttctgcagtccagtacataagacagttcaaaaattgtctggtaatttatgcttctaaaaatttaggagatccttcccatagagcatatctagggtgcctggaccacatataaggtatatatgtttgagaacctcagggagataacaacgtattaaagaattactgagccttccttgggagaagacaaaaatccagggagatgagcctggaacatgtcttggaaatgcattcatgttgttgcaaaaagttatgctgcttgagagtctgaacagtacttttgacagacccatgagtatataagcacagagctggaattcagggcctactgtagttcttctaacacatctgtgctttgaggaggaattccaaagaatttttccacagaaataagtctcagtgacaagaaggcaagtcctcacacagtccaatgattctgtgattgaaattcaactaaagtgagctagactcttgttgtcctcagaagcctgtcaactgcaaatgtaagtcatgtgtagaggaagaagatatcctcgtggtcctcaaactatttcagcaaataattttttaagcataatttctgagatccaataaaatatgacaagaaatataagtagataaaacaacttgactaatgaggaagcaagagagaaaatagggcttcagacagtggatatgctgacacaagcataaaaattctatatagtcatgtactacataaagacattttggtcaacagtggatcacatatacaatggtggtcccataagattataacagagctaaaatatttctattgcttagtgttgtcgaccttccagtgagacaagatgtggaggtagaattcagtgatattgatggttctagccctgtgtaggcataggctaatgtgtgtgtttgtgtcttagtttttagaaaacatttttaaaagaataaaatttttaaaaaattaaaaatagaaaaaaggtttacagaataagatacatagaaaatattttgtacagctgtacaacatgtttgtgttttgtgttactgtaagagtcaaacgtttaaaaaaattaaaagtttataaagtaaaaaaaatacagttactaaggttaatttatttctgaagaaagaaaagtactttttcagtttagtgtagcctaagtgtatggtgtttatagagtttacagaagtgtacagtcatgccctaggccttcatattcactcacctctcactgacttacccagagcaacttctagtcttgcaagctccattcatgttaagtgcactgtacaagggtactactttttaaatctgttatgacatatttttagcgtaggttttctatgtttagagtcacaaaatcgtaccattgtgttacaattgcttacactattcagtacagtaatttgcaatatagtctataaaatatagtccctacaataaagctaggggtatagtatattccatttaggtttgtgtaagtacactccatgatgtttgctcaaaaacagaattgcatggtgatgtatttctcagaatgcattcctgtcattaagcaattcatgactatacatggagattatattcaaggatattaaaaagaacaagataaataattttgataattaaaagctacaaaaagaacatgaaaatgtaaaatatagtttataatattaaacatagttgaatttaacaagtagatgtttgctaaaaaataaatgagttatccacaatgatgccaagtcaaaaatagattaaaaatataaaaatagataagacatttttagaatataaatgagtaaatatcatcagaatataaatgaatgtaattgagtataaagttctcaattatatatatatatatatatatatgtaattgaaacctcgttcatagagaagaaaaagaatgggggaaaattctatatacagaagtaatgtttggaaatttcctcatacttttgaaatcattcagccatacattcaaatggtcttataaaccccatgctttgcagcccataggttaaaaacgaaatcataatggttaggagaagatattttttactaaagaatgataaaaattccacaaataaaaatttgcatggtaaaggaaaaatcatgcttagaaagtttctcataggcttaagtatacatattaaagaacaaaaaggctgaaaattttagtaactaaacatcttcaagaaattagaaaaataatagtaaagtataatatatctaaagaaagttgaatagaggacatagaacaaaaagtagaatcataaacaatggagaagatcagcagagaaaactatattttaaagtattgatataattggtaaattgctggcaagctaaattaagaaaaaggaaagaaaatacaaaaagcctaagcattaaaagataacactactagacaactgaagactcaaaaaagatagccaaaagatattatggacaactttatgaccatttcttgcaagtgttacagaaatgaaaaaaattcttaatagactaaaactgcggagacttacataaaaacagaaaatccaaataattctataacaatgaaactgaatatataattaacctttccacatacactttagacatatatttttacacatatatttttacatacacatatattttcacatagcaacaacaagaaattggaaaaggaaattaaaaggatatgttttaataggataaataatattaaatgtattggaataaattcagtgaaatatatgcaagacctctacaaagaaaattgtaaaaaaaaatgtttagagaaagtaaaatatgccttagtaaatgtaataaatgtcatgttcatgaattggaagattagatattgagaggtttttgtttttcccttgtagaaattattcataaaatttatgtagaaacgaaaggttcaaaaatagcaaagacacttgaagaaccaggtaggaaggacttgttctaccagctattgatttattatattattactccaattaagacaccgagattgtcatcaatattgaaaaatagatcagaagcaacaaattaaaaatccaggtaagacccatatttttgtggacaatattgcttatagagttggcactgcaaaacaatataaaaacatgagtcttttatagaaattatgtcagtacattggcatttctatacaaaaacaatgaaatccgacacctaagacatgtaactcatttccttataatacttaattttcccctggtttaacctgtcttagcctgtcttggccatatcttgttgatgaggcaaactatttatataaacaatagctacttcataagctataggctggccacaggtttttagagtctgctcttcaatacttggttatttttttctcttagctttttgaaatttaactctaagaatatgtcagttagcaagtggtttgctcctaattatactccattaattaacttctggaaagaaaatttaatctggttcaatttaaaagttgtttttctactcatgttccatatatagatgcctcaaaatttctgaaatgtaaattggcataatgctgtaattcttttggtaggatttatatcaattttctttggagtcaatcttaattacatttgaataccaaaatctatattttgtttctaattgtagcagaaaggtttacctaagttaaaatatgtctgatcattaaaaatatgtatggaattcaaatagaaattttaattgctttcttattttaaaaaatatatatattacaagttcagatgtctaaaaatagttaaactagaaaattcaacacaaagaaatgaaagataaaacaattgaattattgacctcacaataaactgggggtgtttaatacaaatgccttaggtaatataccatacacatttgaaaaatgaaaaatgataacatggtctgaagttgccagttacagaagcattaaaatatgaagccattagtcagaatgaatcatattcctattttgtcttcatattgaaatattcaataaattctagtaattccatatttatcttacatttaataatcttcaggaaattaccaacatgatctttgccatgtaacattttctcttttacctttatttcacttcttaaattctgaaaattaagtaaccaagtcattcttttgtaaatgcattcattatttgttattcaataagcaaatctttgttattcaatcaacaaagtgaaaatattagcacttcagtaagatttaaatattcaatcttaattgattcaaaaggtcttctagccaccccccaccgatttctaaggtgcctttttgccaactatgggtagatcttatcacattttaattcttggccctaaaatttctaattagcaaagtattgcacggtatttgagggctgctgattagcatctaagagactattcccaataacattcccagtgtgtattaagtcaatccaaattttgatagattattcttttcttattttacagaaaccagtcatttttccatactaatttggtctcaatgagaacaacataattctcattcatctccctgtagaagttatatatttccaaagtggttcaaatgtactgaaagccaactcaccactaggaattgaatcaaaattgacccacagacgtacaacattaagtttgctgcgaagatttaaatcagtgggacataaaataaaaattgtatgctacccaaaccaaagcctctccttcaaaaaatactgttgtttttgttgttgtcattgttttcccattatgtcacagttcttaagtggtagaaaagcaagttgataggaatcactttatcttgtagtttcattttcataccacagagcttcagtttccttccaggcaaaagtcatcagtgtagtaacagatgcatctttttctgccctaggatcttagaatcaatgggattatcaagacggagattaccttagcaatgagtgagcattgttttgtgcataaaggcattgagattcatataagaattgacttgaggtccactgtctagttactttaaaagcagaatgatataaaggtttattctagctaatctgtgccatttccagtcagctctttgtttttccttgttttctcttgtatatttgcttttctcacatctaggtcaaataactgcttttttggataatgtagcggatctccttatgtctgcctcatccaaactttctccaacaacataactgagtgggcagtagaaagtgtgaggctgccctaggctccagtttattggactagagttgagcagctgagtcaaaattaatcagtcacaatctctatggtgtgaattagaaaatgtgagatggggacttttaaaacataccaactcatcaggcccttctagagatcagttaaagcaggaatcacagggtgaggactacactgtaactccccacttctttctcatggtcaggattcagagccattaatgcagattatagttattttatacctgtttccataggccatctatattctggttgcatatatgtgaatttgtatgtatattcctattatgtacttatagactgtggccacattcatgtatattactccaaaagcataatctttggcccttacctcaatttcaacaattctacaatatctttcactagcctgaataaacaattttgatttagtgttcatgttcctccagccttcagtaatcttcattccaccatagtactccatataatattgtcatgtgtcaactaaatgctaattttttaaaaattatgtttctggtatataaaatgtaattagaaatccaaatagtaaattagcccttaaaataatgcataaataatttatcatgtataaaacttttctgataaaaatatatctctataaaatgataaacactattttgattaattggttaaattgaccttttcctttaattaactttttctatattaaatttattaaaaatactccagtatttaattaatgtttaacatggaaaattgtgtttggtaattgacttaatttttttactaattggttacatattaaatcctcgttttcatagaacactgctcattactaagaataataattctagtcaagaaaatattcatcactttggtagaggtttttttcctaaattaataatacaaaagttaatttttattgaattacttctggttagggatattaaccttaatcaggcaaacttcttatcttctctagcttacagtttaatgcagtggtttgtaatatatcacacaatgcagtaagcattctgcacatatacatgtttgtgtgtgcatgtgtgtatatatacacatatatatgtacacaggtgttttatttgaacagagataattaccattcataaatgcccattggttaattgcttaataatcgtatttagtggctcaaagtaaaacacttgtgcattatgttttacgatactaagatgtaagttctaaccaaatcctgtgctgacaaggaacacgttccttgatgagctctacaaagacctacaaaaatagtaattcaaacaccaattattcatattttatacaaatgtttgcctatacgtagcctaggtaataatcaacctgaaagtttatattgttagaggcatgtcagtcctaaccaaggagactttttctgattttatgtcactacatatatataaatgatgcattttagtctatttaggaaaatattgttagcttcaattccaagtttttatttatttatgaggtttcttatagtttgattaaaataatttgttacaaacctgtcacattcagttattccatgatccaccacaaatagaaattctcaccatctcaaatgtaatagtgcagataagttgtaaatataattatgatatgcacttataaaatataaggataggagaaaaaaatccagcctcttatttgtgtatcatgtcctttaagattatatctagtattgcagcttgggccccttgactgtcacttcattgccaggaaattttcggcagtgctttgaactattttcatcaaagacagaagggtgtggtgccataggagttaaaagactagatcgtctcaatgagaagggtgtgatccagtgaactaggcaacttcaaaagtacagtaaactatgagttaaaaacttctattagttttggcaacttgaaaggtatttttgaatttatggaaagcaatattttatgaactcagacagtaaaagccaaactgccataaagtgaggagtgatagggtacagggtatagtcgattgtagacagggtatcaatgctgaggaagttagcctgggcttgtgttgaaccactgacctgtgtgaacggaaatgtcctcagaaacactgtattaaaggaaaaatctgcatgacagctctggatcacaaaatggaaagccaagcagagcccggccacgggcggcgttgagaagagtaaggttgttgagacttggggaccagcgtagggttaaaatagagacacaactgaccttgatgcttcttaaagtatttgtatttgttctatgatcttaagtcttcactattaaaataattgatttgtctagttctagttctatgcaacattcagagttaaaatcactagcaaagtctcttaagtgtatcagaatccaaaatagaattcagccaaaatcttctcttgctccaggaataggcttttaaaccaagactcagttacctcatcacccttaggaagttttgagttgaatactttcgaaaatccagaagatagactgacctaaactgagttttctttttttttcttttcttttttttttttttttttgaggagtgataagatagtaaaaaacgtctccggaaatcctgagtttggctagcatagtgtagtgaatatgtttctttgtaatgtcgtgaatttcaaagtcaaaaaaacaaatacatgccctaaattactttcaatttttgaataaggttttatgtttgtttgtttgtttgtttgtttgtttattgagacagtctcgctctcactctgtcacccaggctggagtgcaatggcctgatcttggctcactgcaacctttgcctccctggttgaagcaattcttctgcctcagcctcctgagtagctgggactacaggcgcgtgccaccatgcctggctaaattttgtatttttagtagagaagtggtttcaccgtattggccaggctgctctcgaactcctgacctcatgattcacaagccttggccccccaaagtgctgggattacaggcgtgagccaccgcacgtggccgaataacttcttaaatacttttttttttcttcttctaattcttactgtggaaagttcctatgaccctggaaattgagtgaaatatttagtgtggaatcgcctgcattttcatgaaatttcttcaactatgtttttagaatggtgattttataatagtaagttgtcagtaaatttgtgttgattaatcacctgatttctaaattattttcctaacttttaataccttttaaaacgtaaactttaaaaaataattcatataaaacctgaatatacagaactacaaattgttaacattttggcacttttgatttctctatctccatcttcgtatattttgagttacagatactgagaatctttcctccctaattcagcatgcatatctttctaaatgccctcccccactttttttattccagagtctagtcaaggttcacacgttgcttcaaattctttgtctgtagtttcttctaaccaagagagtcccccctccccctctttgtttttcctgatctttactttttgagggatacggattagttgacataaaatgttccaaattttgttcaggtcttttgatttctaattaaattgttttctctataagaacactacatgaaccatgttgtatagttgtgattgcttcttattagtcattaataatgtcatgtttattagacatgatgttaagtcacttggttagtataataattaccaaatctcttcaactgtctcacgttaagaaatgtgaatatcttgtcctgatcctctccacccccataatatttcataaaatggttttaaagccctaaaacttaaagtataataaataaataaataaataaataaataaataaaaccactgtggaaaaaaaaaaaaagcccttgctgattatgtatttaagccatcagtacattagtggttacaaagtggtgattttaaaattctgccttttcttccacattaattatttggcaatctcctctatacaaatattttcttcccactgtccctttgtccccgacctccaataattacttacacaggaaatagcagctagggctagccaaatagaaaatgtaatgagggtaaaatctttctccagcacttggttttcttttctagatattttcccctcacccggtcttctcaaatatcccttccacttgaggacccaatgactctatgcattctcttattctttcctaaatattacagtgactaagacttattagctactttagaactttaaacagatcattcattctctttgaatagaggtttttcatcagttcaaggtagtaacatgtatccttcattgagttgtaagaatttcaaaagataacagtggagtgtgatacatggttaaagtttaagaaatttccattagcaaatgtaaagcactaggaagagataagtatcaggttccttcctgcacttcattttctactgttcttgtgttttaggagtatttatgattattcagctaatgttatttattcataaaataactagtttttatgcttatatacctttacctcatttttggcagagaataaaatgtattatatatatcctatttcaaaacatatggttattgaatagaagaaattaccacataaaataaactcttgcataaagttgcatgtttatgaggtctttgttaattgtctttgttaacattgtctttgttaattgtgttgcttctaccttatttagaatattttaaaaattatattttaatgtcgaatatcacaatatctattggagtttaaaggtaatcatcacacacaggtttaaaacagagattgatggagttagaaaaaaatgaaaattaaaatgtggatgacgttacgcacactgctaagtcagtttgcaccgtggccagatagtcttccttccccaccctcactgagtatgtacactggaaaaatccagctaagagaaaacataggacttgcagcagaaacatcccttcaggtatcagtgggacttctaactcatatttttaagcttgaagaacagtggcagagaaataaaacatagatttgactctacaaaccagaccctgagtcctgaggaagaaccaggttaatggaaaatgaagaatggcaagaagagcagcccaaagagtaaaccccagagggagggagtaaaactacatatgcccagtgctttttgctatcctcagaggggaataaacagggggattacaagagagagaagagcatgtacatagaggagagaacctgcagagcagagatagagttaggattgttccaaggctattgaaaaaagttctagatgagaattgattgctggctgcagtgaagttattaaaaaatggtcagattttggatatattttaaacttcgagtcagtagaatttgctgatggatacagtaaggaatataagactataagagaaagtctaggatgactctgaagttttggacacatgttaggttggaatttcttttttattatgtgtcaaattttatttctctgcacatatcacagtgttttttattgcttatcagtcttttaaagtaagttgttgttttattaaaggcacatcttatttttaaattaaaatgatattacatgactttgtcagaaaggtcaatcaccagcattttgtctcttcatcccacaagattactcccaagatggtaacagtttttctactatttttaagatattttttctatgatatttttaaaattacatttaaaaatgttaaaacattactttctttaaaataatgaaattatatttcatttactcattttagtaactcttgatttcctgttatggtagttgaagatttagctttccacccatcctcacattcctgctttcccttttctcagccttttgactaagatttctttaaactcattaatagattaatagaagatattttcatggtgatgactatgtaaatacaattcacttctaaaggacgtattgtgctatgattacctttcttttcccattgcctcccttcatcactacacactggacttaataattgcttaatttacgttagtttcctatacgtgtatgaacatttttctccaaatgcattgatctgtcaataggaaggattcctcttccttcctatttcccagtctatatcgttgaagtctaggcttgaaacaaagatgttatttgtgtatttctctcacttctcttattttttgtaatcccactctctggatctcatgtcttccttttaaggttttctgcatacacatcttctaatatagtgtttttgaaactttagcgtgcatcagaatcacatggatatctttttaaaacagtttactaggttttaaccccagtttctgattcagtgtatctggggtgaggagagtgaatttgccttttcaacaaattctcaggtgctgctgctgatttgggcaatacactttaaaaactattccagggcacaagggacataagattttgagagcttccatgtctttctagtttagctagtatgataaattgcgctattgcctaaaaccccccatgcctacttgtatccaagccttttggggtttttgtttgtttgtttgcttgtcgtgtaactgcaattctttctactagaagtggagttcacttccctgttttactggtgaggggtttggtaatgttctttgcttgggccaatgctgttttaatagatggaactcaagcaaatgatttatacttgcttgcaggatgagtttctcttatgttttccccttcaacaacaacaacaacaacagtgacaacgaaagtaagaaagaaaaaagccttaggtagtgttgtcatctcaaaaatgagagacatctgaggcaaacctagctgagcctagcatgtagaagcttaaccacagataatctgcaggagcatgggtgaaaaatatatgcttgtttatataagccactgaattatcatgtagtgtaacagtgtgaaagtagctaaataatagaaagcctgggaaagaataattttctctcagagtgttcatttgtttaagagcttacaatttttccccttatggaacattttagagaattcccttcaaatgatttctctgaattttgcaatgatcaacactgtgaaggaccttttctcatttattgtgctgacttcatgattggccgttttattctagagatacaaattcttatctcccagaattttcatatattgctattatattttcttcatgatcacccaattatgttttatttgctcttcctagaactcctataatctagatgttaaacattctagattgagttatcttttctttcatatttctggaatatttctggaatcactatttctggaatcagtatttctggaatattcccttgactttatcttctaaaattgccaattaattaaaaataatagacagttttatccctaaattctcagcattcctggttcttctttgaacgtttcttataaagtcatattttcattttacaactgcattttcatctcacaacgggcattttctctcttctttctgagaataatgaggatctatctacagtatctatatatttactttttttctactttttgttttgagggtttctttacaccattttttgcttatttattgtgggatcccctttttcataagttggttatttttcttactggagggcttatttggacgatatcatcttggtagcagtgaagctttgctataggagagcaggttgttaacttagggttttgtttgagaacactcaaaattaataggagtctgtttttttctttttcttttttttttttttaaattccctagtgtcacttagtttcttgtcaaggaatcttccaggccaactcctgggtatgtgttggtcagatcaggtattattgacgagaatttatgcctggctgcgaggattctgggaataggttagagaaagatccattaacatgtttcagttcaacatgtagttgttcaatttctttctctattttcagctctattcctcaattatgccgtcaactgagtatgagtctggggtgtccccagctcaattttctcaaagaggaggaggagagtgccttagctgtcctttgccctgcaaggcatttatattattatttccttgattgttaagcctgtaatcatgtcttcccacatgctttctgccttctaacaaccagaaataacttgcttgctattttctgttctcttgttttctatccttgggtttataataatttatcatcactttagtgaattcaagggtgggagttgagaggaattgggaggggtaaatgagcacccgtgttcaagtagaggtataatttgttaactgtgttagctgaactataatcttcatgaagagcggatgtgtagctaccttatttacagttctatacccatgatctagcacagtgccaggcacatagttagcacttatttaatacgtgttgaatgaatgcttcaaaaagaaatatgtaatatttagatatctgtttgacagagtccacggatttccaattcaaaggagaaaatgcagagatgttgtggaaagcaggccagaccattatttttacccagcacagtggcatggacagacagataattactattaaaaaattcagtccgattagccttgctcttagttaacatattttgcaggcactctttacacttaatttttttccagggaaaacatccttctctagttcaaagatatatggatcacattcctgggccattgtgaagtattatgaagtgattcttctctttattttgaaaaaaatggaaggtcaaacaaataatttttctttttcaaatatttgtggtgttttgtcgtggtaaattgagaggttatgctccatatcacctggtatgtaaaatatgatccacttaattcttaaaagatagttagcttctatttgaacaaatatactgtccagtagccttgtaccttgtgttcttgaaaaacacacgtgtgattgtgaaatactttggtaaagaatgcataaagcagagacagatctaaatattcttttagtaagattagaatttctcagcatttttaatctggcacatatgagaatattgctatgatgaacgtgcatgtatcagaaaaggtaagttacattacttaactctctattgtttttaaggaaattctaaatcctaatttggtttaggcctttaaactaatgtccatataacccagcatgacttataaaatctgtgattataggcatgtgtttattagtatgtgtttgtatatcaaaacatttatatgagcaggcaaatattcttcagataaatcatacccttcctaagtattttcctccagagaaggtcactagtttgagagtaaaagtacatatatacgtgtgtgtgtgtgtgtgtgtgtgtgtgtgtgtgtgtgtataacatataggtttaaaatgaaaattccttggctatagaaaatatatttacatgtatataataaattgctacagtattacaaacacccatgctttcttattacctgggaaatccagatattccctttctatttccatctatacaattcagcttgaaatcaaatcgcatctatgaaagaaagagaacagaagtcctatttttatgaaaagcaatgccgaagccatgatgtgtctaattcacttctaaaaattctacttaggtgcaaggacgtagaagacactatagtttgcctattagcttttgctgtatacatagaaccgaaattagtatggctaacaccctgtgactatggccattcttaatgactcttgtaatgcttatggataaaactggttctcaattatcactctggtaattggggctgcatttttagcataagcgaacaccatgggaggcccagaacttcactgtggcacagaacccccaagccttctcactctgtcctttgtcttataacttgatcttcatttcattccaaaaacttgttctgatttcagcaaatttctctgttcctggaaaagttgccattaatgtacattaatttaccatcatcttctgtgtatctgtccttccattctggactgttagcccctttctcctttctagttttccatgatacgacctttattcactctcctcctgcagtagccttttcaagatattattcctaatggatacagatgctcaagtatgtagacctgccattcaatatgatacatatcaggggcacactttgttttccttgtactctgtctgtagactctaagtcctataattgcaggagctttgtgtatcctctaaatgatgtatcctcagaacctaatgtagtgtgtagtacatagtaggcattcattacgtatttgttgtgtgaataaatgcaattgtttgtgattgtattacattttgaacttccacatgccaaggtctattcctttagtccagatactaaggcatttgtctgcgaattgcatcaggatctgagtcatgttccatcatgagaggaaataatttactatgattattgttgcccttaacggcactaaccacaaaagtgcttgtaaatgcctaattgtccatggagatatatgtggtaatgtatgataaaaggaaaagccccaaattttcagagtttgacaggcacctcagttgtagactcatacatgatagaacataagaaaggcagaattcaggccattttatgtaaaattaagaaaaataagatttcctatttttgtgtctcaaatggtttttttaagtaagctaattttatgaaaaaaatcagaagttttatgtgtagttaatttttcattaacaaaagaatagaaaaatccaaataacatacaggtgatcaacacatttcatgcatacaaacatactcttattcatgcatgcatacatacatacagtttttagaaatgcctatacctaagtaataaccattagtaaatttctaactgagatcctcttgataataaaagatagttaatagcttaagaaagtccttgttcatgcttcatgtgtcattaccatgtatttaggaaattcaagcatataaactctaagtgacaataatatccccgttaaaccagtgagagatatctgttatttaaaaaaaaaaagattgtagttgacaatagatgtgctgacatcatcctaaatatttgaatttgctaataattgtcctctacacaattgtagtaagagttcatccttaagatgcatatgttttgctaatgttaagattagctgattaatattgatggcagctaaggccagtggctaatgtctgacatctgtttgggaaatcattgttcccattcaggaagctggcatttctgtagaggttagaatgaggggttagtgtgtaaggaattatgattagggttttgtgtatggttaaggttaggaatagggacatgttctatctcatttctgttcatctcaatgtatttctggtgtctagttgcttgctctattctgtgttaacagagaggtcttcccctctgttcccttgtggcacattcactgtggcacattatttcacgtgctccattctgtgttaatggactgattgatctcattttcttatctgtgttagtccttactttgtccttaaagaatctcttcttttgggatagaaacattctttttgttccaattgtttatttgagtcacaggtggacactttaactgatttaaagtgggaaattaatttttacctcatccttttccagtgccaccttaaccttaatcttaatactgaaaccatatcaaagggaactgtgttttggttttgggagggaaagctattgatatatggatttctctcccaaaattaaaattttaataaatgaaaaattgtaagccaaaaaagtcttagtcctttaatttttttctaacacagctatttgttttattttttctctagtgggctttagtattaatcagtgtatagaggaggtaaaaatagttttcctataacttatgcaaagggaagaaatgaacatttagtataacaaaagactactgaagtgaggtaaccacagagactcagaaaatcaatcaacctaagaaggaaagaacaccaggacctctcaggatattgaatgaatgcacaattaaagtctgttttccttttatttccatttctctttaactgaaacatcaagtggaaaatcatgaaaaccttgaaaattcaagaaaacttttaaagaacattcgaggatcttactatattgatgtacatagtttgatatttttaatgaagttctttaagccattatgtcaatggcttcaagacattttgttcagtaaatgaaaaatgaaacctttacaaactcttgtaagattttcattaaacacttcaaaaaatagttttttatgtaaaagtttctgtcagcatcaaaaatcttttatttagtacacatttcctgtctgttggggggaagcaaaactaaatgagaagaaaattgaaattatctatgtatattccttattaaatgtaagtgggggctagggtggtatattcttgtattactattaatttttagacagagtttttttcatttcacaatgatatcccagtttgccaacttgtagactgagaaaagtgctgcttaaattttttgtgcctaagactccatatctttaaaatgggtttagcaaaatagggataatcaatgaaatattgtatgtaacacgtttagacatacctgatacgtagtaagtacacaatacatattatttaatattagtaagggtactaatattatctagcatgatagccagctagctctggaccttttttgtgctcaaattaatgaatgaataaagaaaaaaatatatattttcttcacaataataagattcagggacattatagaaacttaaactttgaagttatttagttcacacttttaccaaatatgagagtaccataatttatgacaagggattaaatggattcacaccttttttctggatttcttagaagagattaacgtttttgtcttgcaaaatatttttcttaattaaaatgaaattgaatgaatttagcatttactcattggtgctcacttcaaccccaggaatgtcaagagtgggttcacattttcccacagagttgtcaatgctttcctcatataataacactaaacattggattgtaagaattatcaccctcttacatagactactgtctgagtaaaacatttgttctcaatttacttagttttcttgggaagtaatgattcagtcattctgatttgtaaatgttttcttgtatatctcatggccaagacataatagagactccaggaaggtctgacttactcttgaagggaacattaataaccactacaggcactatgtaagttgtagattgtttagttctccttttgtcgagaacccttatagggcagatttcattattgtcatttcttcatcaaagaaactgagatctaccttggttatatcactttatttagatctagtcacaaagacagtcagctctcaaacctttgttttttctgatatttatgaaaaaatgacctttcccatttccatttagttgctattatcttctgccttattctggacaccatagtgtaaacacttgtattctttaaagctctgtatgagaccttagacattcaccaaaagttaaaaaaaacactccttaagaagtaaaattattgtggttaattaggctcctgtatactaaatggaattccaattcagattaggggcattaaatataacattttatttaatcctcaattatgagataggagttattattgccatttaaattaatacatatcatataccttcctagtcacacatgaattgacttgttaattcatagaaattgaatttgcatatgtcaaaagttctactccaactttatgaatgctatttaagattgggttaggatttttggtagtcacggcatagtattacctctaattcagctgttgctgataaaaacacatcggttccagatgcgctattcagtgaacagtctaatgtctggtacctatgtgattaaggacctaaaggctagattcttaagagaataatttattagatcattgctcttgtgtaaatcttcccttaagagagattcatactcagtctatagtaattcacttctgggaccctaaagttagttgcttggctctgctgtgagataaaagtagtatcaaataataatatgatacaagcaagaaagcaaaataaagggaaagaaggaaatttaacagtttgatattttgattgatagttgcagggtctatgccaataaaaaatattatttagatagcattaatgtagttattgactcaagcaatatgttcatgcatgcaatattttattttggtattctttaccattttaaaaataatgataaacaatggacatactctttctctgaaagaaaataacaagataaaggagttttgacatgcagtttgagtaaatatatctaaaatatgtaatgagaatgggagctttcacatctgctgtattcattgtcaaaacattattctagatattttatttaatctagtaatataattatctagcaaagatagtaatttagtaaagttttaaatttaaaaaaagaaattactggaattgtggcagcaaatggatatatttaaaactgagggcaaaatgaagcgcatatcaaaagaaccaacgaatgagagaagataaagataatcaacatactcagacagaaaagtatgcttagtacacagcagtgagcagtttctgaggtttctggtgcaagggaattacctctttcaataaaatgaatcaattataaccaaattatgaagtaatctcttactgtttgattttttgatacatgaaattatttttactgcagattttaatataacaatatgttatagtcatagagcacttttcctaatttagtaattgaaagcttgtgtaaaaaatgtttctctgtttttgttttttttcttatattggccatgaaaacattcttttgaggaagattttattttcccttgctaagtttcagtaaatataatttagttgaatttaatacaaccagatgcataagatgaggtaggtaatttaactgtcagatgaactatagttagttaaggtacgcaatggattttgtttttcttccaagcaagtgtcagttaaatagcaatcatttccttcaaaatactccctcacctcagcccctcaaaagaatttcaatgctatttttgaaaatattttgaattactggtcataaaggagttctaaaacattcctgtgaagtgctttagagcttcacccagtagtgtcaggagtattcattcttacttgaacaagagaacggaaaacaggactggctatagcagttgccagcttcaaggattcaagtgcagaggaaatcagagaaaagaacaggcagaacagatggttaaaagtaatttctgaaattagttcaaattgttttaatagctatttgtattttaacagcataatttaacaatttatattttgagattatgtctatgaaaataagtcccaaagtgagaaaacatttgtatatatatatataggaatataaattttcagaactcagtctttaagactgataacaatcatcataaatgcaaaaatctaaaagaaaaaaacaagtttcccaatatttattctttgttgtctgattttatatatttaaaaaactattgaaacatctgaatcttcgctaaaccctatagagaatggctgtatttctaggcaagtgttctaattatgtatttttcctttatatagtatttcttgttgcttgaaaagctcctttctaatctagcagaatatgttagaaaagacaatcccagtaactgagaattctattgcatcaggatctattatttatatattttttctttttgagcttatggtgggcggtttagagagctgacccattcttctgtctttgcgtgtgtatttttaaattctagtcattgtgtagtgagaatatgcaggtgtttctcagagaactttttcccctctagctggatgtggaaaggacaatgcaattaataacagatggcacgggatgaccacgtccttgagagaacgccttattggcacctcctgctaattgtatcacatataacacaactaaaagcataataaatctgaactgggggacattttatgcaagagctcttctccttttccagacggtaaattgctcagctcttgaaatatctataaccttgtgacactcaacttgcattagcttaattgccttttttccatctccctcccccttctaccctccctttctctttctctccttctctccttctctgtctctccctttttctcaccctctcactgtctctttcttgttgtctcatatttttttccctctaggtgtgaggaaacaatttgacatttgtttttctacctagtttagtgctgcgtctaatacagctgtatttcctagcttgtatagaattttttttttttttttttttgacggaatctcactctgtcgtcaggctggagtgaagtggcgtgatctcggctcactgcaacttccccctcccgggttcaagtgattctcctgcctcagcctcccaagtagctggggtgacaggcacgtgctaatttttgtatatttacaaaatatacccgcccagctaatttttgtatatttagtagagacgggatttcaccatgttggcccggatggtctcgatctcttgacctcctaatccacccgcctcggcctcctaaaatgctgggattacaggcgtgagtcaccgtgcctggcctcttttaaagggctttaaaacacttttcttaacatttgtgttgagaaagaaaatgcctatctgattctgatgtaatttaataaatctgtaaaaaaaaaaaggggggctctcattaagtgtaaactcatgtgagcttctgatggacatacacaataacacacgtacgtatgtaaacaaacatatccattcacacacatgcacaggacttttttctttttttgcacaatggcaataattcaccatattctgtagcattgaaaaggattgcattttcttccatttcataacctggtattattaacaatttctaaagtaaaagtattatgatatgccagaaatgtaaccacccagcaattatctttttctttcctttaagaaaatgctatagtgagtagcatgaatttcacagcaagttcctacacatctattttcatttttggtggtttgcctataaatgagcaaacaaaaagtaatttaaattacatttggagttaataacaaatacatcaaaatcatgaagtatgtgtagaaattgtgccttggctggctagctctgtgtgtgtgtgtgtgtgtacgcatgcacacgtggatgtttgtgggtgtgcatgtgtgcacactgacacattctttccttagctatatagatgtctgtttctttccagtgatttatctccattggtgagagtaaccttagtgtttatgtcagttggatgaaccaatgctaaaataagacaaagaatagctcattcaagaaatgatataatttaaaagaaagcagccatattttcagatcttcatggtattatattcctaaatctcctactgatgaataatttgggcaaaaactcctagggcagttcaggacctgggacatacctgaaattgggtataatggaaagtgaaaaattctcatgattctgaacatgcttatttgggctccggtgacacaagaagcattgttaggagttacgtgttaactatatagaccccaatagtaggtttgtgacagatgaaagaaagttaacattagtagtagtattatgaatttcaaaagtgcttaactcacaatctgcatttagctgatgaatgaccttagtaagtcctactacttttctgagcatcattatcttcctttacaaagtgaggaatcagaactagaatgagtaatattctaatagtactgccttgaagagtaggatttctgcagactcccactgtagattggggagagatcgaaggatgagagtatagtgctacaagccactattctcagatgaattttggtatcatttgttgcgtttatatgtttcatatacgatttacttggagcaatcttgtgaatgtatgtcttcttgggtaaaatcattcaaaaataattagattgcataattgctaaggttcctttcagctagaaattctatgatatatgtaccagcatgcctcctaattaatatgatctaattctaatgttcttaatgaatgaaacctggcatttagaaccaataaatgccgttgatttaaatactgcatgatacatggataaacataagtaaactcctttgcattaaatgtatatttgtgattaaatatttaaaatatacattactttatgtttctagattttaaggaatagcagttatttttacaacaggcagaatctctaaagctcaagtaaatatggatcttacgtttgtttgttttatttcatggctgtcccttcatccccatatatttatagtttactatcttgaggtcagtgcagatagaaggttgctaggtagaaacatgaagataggtttaccacttttagaacaatgaataaaataaaagtattaattagagtgatatttgatgtttatctcatttgtgttcctaccagaatcagatattttctaggagtagattcttctttctggttcagtagtcaaataaagatgtttatcctgtatacagagaaaaaaaggctaatgtgatagaaaatatactcatttttatatattgctgcccagtaatttatccaatttctgactttctcacttttggttgctgtgaggattagaacaagtgaatgcatctgaaaaatataaagtcttgaataaatgcagtagcatcctcatgggtgggagccatctcttattcgtctttgaagcctcatcacttaacatgttttctaatttatagtctatgtttgtcaatatttgatgaatacataagtaaattgatgaataaacaataatatacataattctatatttgggccagttcataagataaggtaaatgctatgtaatgatgagtttatattctctgaattgtttataagaaacataataaaaatcaataaaccagcatatactgcgtatctatatattaccttatgtgattgtaacaactgaaaaaaaaaaaagctgatgcttacaaacatggctgattgctttcctgtgtacgaatattaatcagataccatcatttaaagggatgggcagaaaacaaagtgagagaaaaggattcagaaatcaaatgtgctctactatggttatattaacttttcttctctgcaactccttgtgagttttgccactcattttgaacccaaatttatctcaagtccacacacaccaggtgatatctcacttatattattgtaaattatttacaccacaaattctaggtcatgaagtagaggtgatggaatatttttacaaaaaagttgggatgttgggatcatgttttattttatgcctcctatagtgatcattttattctcagtgtatgtcctacattagcttctgaatttggatattagtgcaatgaatgggatcattacatagcaagcattccatctttcctgtttaatgttatgcttcaaaccctcgggaattgctgatatattagaatatattcaggattgagtattacatttgtatttacatatgatttcaggtaacttatttgaaattccttagatccttgttctcttttaaaataacagtgacaatagcaagtactgacctatcatttagagttggaaatcatcataatgtttggcagcagggaattggtaagtggaaatacactagctttgaaatttatctgaactggattcaattcttggatttttcagttactacatgattttgaaactgtttctcatactctagtttgcttatctgtaaaataccacaatgaactcattggatcatttagaagattagacataataaaaacagagtgcgtagtacagtacctgactgtattcattcaaaacttcgtcttttgttactattattataccacttcttattaacaaagtgaaaatgttggtttagatcagcgttctctagcagaggagagggattttgctggtccctagttcccagagacatttgttgatgtttagagatatttttggttgtcatgaattggggggaggttactacaggaatatggtgtgtagagtccggggatgctgctcaacaacctgtaacacacagcacagtctcccacaacaaggaaacatttggcttaaagtttctatagtgcttagattgagaaacactgatataaattattttgaatcacaccactctcttgaaacaaaaagaaatgtattttaagttgtaattcaaattatctgcttcagattccaagaattgaagctaggaagcatctatactgaatggctgcaatatcctatctgttatgtttaacttggtcttaggctacaggaaatgggttctgcccttcatataacttagaaatatctgaaatttttcagttatttaagacatattttatctgaattttaattacctcctgatcaaattggctaagtagttaagaactgaagctctcattgacctgaattagttattctgtgatctgtgttttgtgctaccttttgactttgctattttcaggaaatgagagggattatggagaatcaacgctgtagtggatgactaaaagcataattactttagcttagcacaactttctttactaacattagttttaagtttatgctatttactatataaactcaaagattttattcataccaatgcaacttggaatgcagtcaagggtaatataaatgattaatttaggttggtatgcagatgattcaaagatcgaatatcatcttaattggcaagatggttttgttctttaacagactgataaaaactgtctttatgttgccattgagtttctataccttgtcaatgccccaaagattgcagactttaaatacaagaaagcagagataacagacatgaaaaaaaaaacagaagaatctgtgaaaatcatttacttattcaactttattcaaaactcaacactcttcaagatattcatgtattatataaacaaaactattttttcccatagagaaaaaacataatgttttataattgaaacttgtgtgttgtagatatgatgggatatataccaacaaggatagacaaggttctggttgcctacagacctacatgtggacccaaacagaatgttcttgatttacaacttttttttttttttccaaaatacgcagcagtatttttagaaacaaaggggatggcacacacatttcaatcagcactttccccctgagccctcagtacaatctgtacaatctcctgtctttccctacttcactttactacctttagggcccttgtctgctacgggtggagtataaataacaagcctcaacaaaagacaaaatagttggatcaaacaggcaaattctctgaaggaggcaagagggattagcaatgtcatattgacaagctgcactagagggcaagagagagaagaattccagcttcagctacagttcaacagaaaatagagaaggtaaacttgaacaatcacccttgggaagttagtagaatctgtttaaaagttgctttcagatatccagaatttatttaggaagaaaatgactccataaagtcggtaaaaaatattttcatatctcttcctgaagataattcattggtttgcatgaagaaaccttttttatttttttaaaaaggaaaaacaaaatttatttttgtgagaacaaatacacaaggaaaatattatgtagcttcaatagggtaataattttgcaaaaaaaaaaaaacacacaagctagacaatttcttgacctttcatttctgcaatcagtcagttggatgtctccctcttcctctgatgagatttagagctggggactcaatgtgttggcagtgcctttgagccaagtactgtcatgttctggtaaccatatctcttattagaacaaatatgaattcaagtagatagcaagacgacatcccagtggaaattgtcgcacttggttatttatctgtcatcagtctactgaactagcaacgaggaggagagatgaactatcacctgctagatacctaattcatctgtttgtttaaaactgcactgtggaaatcaacaaaagacctcttccttaaaataccaagaactgaaaacccatatctgctcttctctgtgtttctatttaataagggatggctgtaaagtgttgtgtttgtgatcagagctaggaaccaagttttgatcaacttctaatgggttaaataaatcgaatgcattataaatctaaaatctaaacatattgcagaccctgaattgacttgtagaagtaaacctattataaatgtattaatttcaatgtaaaatatgtgaaaataaagaatattatattgaaatttaggggatataaagaacttaccaaagaaattttattactcttaaggaatgcttcaggggaaatgaggttttatgataacatgtaaaaggaaaaataattagaaaggggattattaaacaatggaaattccatatttagaagagacatattagagtttcaaaatctattattaacagagatcattatatatgaaggaaaacatttaaacagctatttaatatttttcctattttctgaacattttatctcccacttgaaatatatgggtaaactattcactcatattgtatacaatagacaatataaatttaagagccttcaagttatatgaaccaagttgacatgacaaaaaagtgttaatacagttggaagcatattgaatacttttctaaacatggctaacttagacccaatggttctacaaaacaaagctgacttcctggaatgaatgaacaaaacttgccatgatgcagaacgggagagtgattgcctaaggaagtggaaaatccaagttgtctctcttcatttaaaaggacccactttctcttgtgtaaatgtcatcctacagtttataatgaaaacttgaggaaaccccgagggagacctggtgcttttagtaaatgatgcaagccgcattgacttacaataaaaatcagtttctggggctatttactgctccctttggcatccaatctccctccttccttcatgaaaaaaagagccatattagggccctggcagagggaatgaaaagcattgggattcctagaagatttatgcctccctgagaatgggctaacttgggtaaaccaggatgagaaatggcctccgatgccttccgaggcaagagagacagatggtcaagctaaataaaaaacagaaaaaaagttgatttggaaagttggttgatgaaaacatttcagtagattagatattttgtattaagttccacacaagcaaacattacacatacataattttttacataaatgttccttctcattgtttcaaaacaaatgctatgaagttcaccccgatttttccaatcaaatactttctatctggcatttggcaacaaaacacagaaaacaaaacaaacaagaaaacgagaaacacaattttgaacacttcctaataatatagaaaagcaagattttagccaaaaaaatccataactttatattttaagagaggttgttgcctcaattgaccaaggctctgactttttcagaaagaaatgtaattgtcttttcttttcttttttctggtcccatgtcaggaggttaagacttgtattacttcacccacagaagatttatcacaaattcaagtactcagagtatgcagtgttttcagggaggaaccacttattctgaagttcatatattctcaggatttctggggtaaatatttgcctacaaaagttagttaacacacatacaatacaaatgtaacttgcataccaaaacgcttaccaaccttttaaatttaaaacaaaaaacaatataataaaaattcaaaaatcatttatataaggcagctgccatatactatgttacaaaacaaatattaaatcatatattaaaaggttgtttctctccttgaaagagaaatatgtaagagaagaaagataaaagccaggagaaaaaaggaaaacatttcaccatatgtatacaaaacaaaatgctgtattcagtcatgttaattggtagaggatgcatcagctgtgcttgcaaagggcactaatatgtaactgaactatcagccattgtgctcactggaaagggatactctcctacccttattcaatctgtaaagtgatatagcggtgcctcccacaggcctggagacacagttagagtccacatgcacaaggaatgtcaaaacatgaatcaattatatttctggccagaaaggtcaagtgtggaacttaaacagctgagttaaaacaagccacttgtcaaatctgtcctagggacatgaagccagagtcttgtatctcaatggcagccatatcttggatttgggacactggaagagcagaactgaaatactatatttcaaaactatagtatttaacagtaaggtggacttggaaagtaagtgtaaaacaatttcaatgcatgataaagaatatcactttattttacctaaaatacggagaagtatatttcatatttgatcctcccttattttttgtggaatagtaactaaatggctttgtgattaagtggcaatgtgattggaacttcaggtacatcatcacacttaattctcacaaaaaaaatgaggtaaatctcatctacaatttataatggagaaagctgagcctcacaaaggctgatgaaatttttagctgtcatagctagtatatggtatagccagaaattaaaacagttctctctgctacttaagtccacactttttctaccaaactaatatgagcttcatcattttacatattttaagccactgctctgttttgttttgcacttgtttaatatgtttgaatctttaatttttcactaatgttaataggttgaaagttaattgtgtaaaattagatttttttctttgatcagcaaaacaaccaagagactttaatccaattcacactccgatcaattggttcaagaatgaaaaaaattattttttgcaaaatcagacaaatgtaatgtttctgttggaataaatatgtcatgaggctaataagttcaaatataagatttttcttcaagattagacttgctggaataatattatttataagatataagtataatcacattgcctataaacagcctaataattaaagaagagtttttggttattacatttatttaaaaatgagaatttttttttaaatgtccaataccaagaaagaggctaacttgattcttggtggaatggaatttaggaagggttctgagagatgtgttaagattcctgctatcctgtgctctctgctcttcttcatttatttttctttttctaaaaagtgaaaatataagaacatttacaggggaagtaacattgttgagtacttactatgtgctagtgaatgtgccaggtgtttttcatctattgctttatttaagctcagacaaaatgagcattattttctccctagcactaaggaaactgagcctaaagagatccactgacatacctaaaacatatatttgggaaatggtagaacagatatttaaaccgagaaccctggctttagaagtttcattttctcattactccagggtgtttgtggagatgcaaaattgatcccggacttcatcagttttccttttctggggctcaaaaagcatatgtttcaataatataaaagagaaatttaaaagtttgagaaatagtaattatgtacactttagactttattagttaatatgcaaattcaatagctaacatgctctaaaaagattgcatatttgtaagtttaatttaattctcttttttaccttgagtcaattttgatatcagtagtattgaaacgggagagttccctgaccccggtcgcagtacatgcaacaagagtgtggctcatttggagaactacaaacccctgatggaagagggagcatgtagatggacaggtgccggagccaggactagagcttttgggctctggccccacagtagcgtctaggggtggatgtctgttgactcctgcagccccagtgggcatgttacagtgctcctttagctctcccaactgcagacagcttaagagttaaccagatcagtgccctcttggtacctggattcttgtctggcatctgggaagaatcaggtcacctggacaaagtgaagggtggtaaatgcgagggattttattgccagatggaggtgattctcagcggaatggacggggagctgcaaaggggatggagtgggaagatgaccttcgcctggagttcacccatcctgcagccaatcttctttccatccaatcacagccaaactcctctcgatgttcagatgctcctcttctctcctcctctgccatgctgctcttctgctcctctgctcctctgctcttctgctcatggagcctggggtttgggttttatatgggtacaggatgagggtttggtgggccaaaagggaacatttgggcttgaaaacaggaatgcctgttcccatttagggccatgggtttccaggctttagggcagggcctttgctggggaactgctctcttctgcccagtattttttcctgcctcctgtctgtatcagtgtaaacaattttttttttaagttacaaataattttttataaaaaatattgtaaattcttttttaatgccaatattcttacttgacttctctttccccagccatttatgtgtttctaagatttctgtggacacagttatattcttcaatggaagatacctttctttgaacctataaagaaaaactcttacgtatttacttacttttagcctaaggatagagaagccaatgtaggaataatatgatggtgaagtgatgaaagtaaaaaataaaaacatcatgctagtgctattataatatgtaattagtgtggtctaaggctatatttttcaaaattgtaaaggtatgttttatggaatattctttgagctgttctgaaatcttcaagttacacacacacacacacaaacctttttgcttaaaaattatcttgtaaactcctgctgtatctgaattctaaaatttcacattaacctgttaaatgccgtgtcaagcctaagagtaaataatcttttttattaccaagggtctccccaaatttatttggccaaaaatcccatctttcattttatacctactaataatatctagaaatagaactcacaattcacattgggaaactattctaaatatatattcaaagccaaaagaaagatttactgtacccaatttggaaggacaacgagaataacgatagattagattagaggaacttgaaatagtgtaggcaagcaatgatgagggttggaattaaggccacaaaatggcatagattcaagaaatgcccatgatagggcttagaattgatctgatttagtgattattcagtgaaaaagaaggagtcacatatatcaggtctggcttgagtgattggttaaacggtggtataacttgccaaatggaggtctggaagaaaaattgttagagtaagaatgtgagttcacttttgaactgttgacttcgaaatatttggggttcttctaggtcattttttccaataggagccagaaatagagatttagagcataagaaataaagaataaaagcctcagcaaagatataaatgtcaaagtcactgtgtgataaaaagctcccaggatatggatgagactgcaggtgacttactcttcaactggtagggatccagctactttgttaagtgtactaagcagagcaagatgttgaaaatgtacactatattttgctagtatagatcgtgttttagaaaaagctaaaagataagtaaataaaaataaaattaccaacatattaaatgttttccatattacctgtgacaaggggcccatgatgctgaaactacagtctcccaaagagaaataggcagaatttaagaaagttagctgatgaagatgtttttaatcttctctgtgagttcatgccaacaaatactacattaagcttatgaatacattaatcaagaaaagaggtgttgagtaatgattcactcagaacttaaataatcctgtgatctatttgaagcagcctgacaccattataggaagtggtaaatgtgtttcctgttaaacatttgctcagttcatttacagtaattctgtattccttcttaacaattcacttttgtctcacacttgtgtgtttatatggaatttaatactcagtgatgcccactgattaatggcatgcttgaaaatgtttgtgtgctgtcaagctaactgaaccttgagttggtatcctttctcatttcaagaggataataacagtactggggtaatgtgggctaagcacctactctgtgccatactttagtagaaacttagcatgtagaatctgtcaaatcatccttgtaacgtaatttttttttattgtcctttaaatacctagaaactgaaactgtgggagttaatgtttaaagttacaaaatcagtaagagtcggagctcaattttgattacgtggttgaacgattctacaggctgtaatttttccattgcctcatccttcctacatatggaagattagaaaacaaaacactgaaagaggaattatccctttccacatcaactaattacgtcacatagaggggtttacatgtaaaccttcatactctacttttcctctatttttgtaatagcaattaacagaaactaatacacttgagtaagactgttgtttttgagcttcactttcttccagaaaaaacacttcagtaatggtgggcttatactatggaagttaaggaaggaattgataacaaaaaatgtataaggaatgccagacaattgttccaacttaggaagtgacgttgaactctatagggaaacactggtgctgccttttccagaaaaatccgattatagtattttttttaaataaggaaagttgagaatacatttaatattccataaaactgctctgctttgattttagaaataatcagagaaggaaggcatcagttattagatcatttattcaaaatattttaaacaaattaagtgagcatcaattactttcttatatatgatgagttgttgaactaaagagaggatctggatatcagagagatgcacagctctttgcccatgaaaagttctttattctagttcttttaatttgctttaccccatgaaatttattatgccttccatgtcagtatggtatggggttaactttttaaatttatatttaaagtaattgaatattatcttagagccccgatattcgtaaacatttacctaaaaatttgttgttgtcagtatctcacagtcactaacattgatctacttttcttcaaatacatgtttaaaatgaattctcacagataagtaaggtaagtagaattgaaaacaaatttagccaaaggaaagaagatatgtgaaaatatttacatgaagttgcctgaaatggtactgacacgcattaaaaaatgtgttatataaaagaaactttccttatctctaggtggaatatccacaatcattctaaatgttttttgataagttttgacattttgaaatgaaagttattttaacaaaaaccacattcaagaaagatgcttaaacattttaaatgatgcctaatgtggtgaatatattgtttctcttacagatagagatttttatcaaatgacatttttagtatgttatgaaaaaattaatattaagaattatagtatgaattaaatgtatgcattttagaggtagaggagaataatgaaacacatagtatgcaaatacatccttcaattaaataaaattgtcatctttaatacttttattaacgtcttaccaagtttgtttccattcactgtagatggttataaccaaagagataactgtttacgatcttctttgagtaaaaatcagaaatgtaagcatctatagagtaaattattttcaggaatatattactgatcaatgatggctattttaactcaaagctcattttgaagggaaaaaataacaatgcttagcacttttataatgctttttgtcttcaaatcacttaattaattctaatctttacaacgcccctgagaggtggcaaattggccagatctgtttttcccatactgatattattatgtgcatgtatattaaaatcacagtattttacttcttaaagtaaatttgtttgtagcttcaaataatataaatcatctcacattcatttagttaaaaaaataatgttgtaaaatgaaaacagattccaaatcatgtttggtaatcctttaggagaaattccatacagactttagctttggattttcccttttgtggaggggagcatatttgaagttgtggagcatgatgggtccaggacctcagggaccctagattctagccttagtttttttattaactacgtgtctgaccttgaaacttatttttctcagctacaaggtagcgataatgttacctgcctggcatttatcacggggatgtttgatggttcatgcaacaatgtatgtgaaaacattttattaccttaaagcatttttcaatataattgatatatttttataaattgaaagacaactaacatgaaatatattcctatgggcagaaataaagattgtaggagattgcattttagtttattgattcagcattttacaaatgtatttattgagtgtctagtattacagagagcacacacagttgacatatgaagagcatgtatggagtgaatgagttgtatatggtgaagcttgataagatgtagatattcattatgagtccattgtggctggcatatcccagaatttttcttaattttttcattcaaagaagaaagcatgggactgatactccctctgaatggatgatcttatttattaatggggagaaatatatgggtctcatcattttcatcatgtttaactgtaacaagttaaaattcatcaaaataaagatttcagagtatagtgttgtgcagtgatatatgtagtatcacttcagtacctctgtccactggcatgagccccttccattttcacttgaaaggtaccttttgagaggtattgccttagttaaaaatattttgtcctctttagagtagaatggcttctagcttaggcatttccatcttcatttatcttttgggttttcctctttccttgtgaattactccttctgaggcgcctatattggttattccttatctgttagacatctaaaattgagaagctccagaactcatagtactcaggtcctttttctgtctacattgactaccttggtgctcgtggtcattgctgtgactgcaatgctgtaaacactcaaatacaataatcaattttatatctcttgcatacacttctctcatgatatccagaatcatgtttctaatactattcatcatttcagcttggatacatctcatatgcgtctcagacttaagaggtttaagtaatattcctgactctctcctgtgttcactccattcctcctacaattttcctctttgcagtcagtaaatggcaactctactcttccagttactgaaacaaaggccccagaattcctcttgatttctctcagtcacatatgctccacatctcctattggctctgttttcaaaatatatccacaattcagccacctctcatcacatcaaccaagcacatcctggctaaaactactatgtgttcatcccaacccagcagttccagactgttattcttacttccacccttgctattacagagattattctcaatatatgatacagatctgtggttctcaaatgtcagcatgaatcagaattacccagaagtttgttaaaacagattattgggctctatcctcagagtctgtgattcagtaattgggctacagaattggcacttaaaaaaagttactgagtgatttgaatgtcagtgctctggagaccacccattgagaattagtcatgtagggcttcactactcatggtatggtccactgaccaaacatatcagcatgacttgagcttttcggaaatgtagaattttaggctccacttcagacccactgaatcagaatctgaatactaacatgatttccaggtgatccttctaaacatgacagtctcagaaacacagattaaaaaaagtgtattcttctttatagtgaagagaaatattcttcttttacatttcaagtcacattattttcttcctttactcaaaataggtttccttctcaatctgggtaaaaccctaaatccttaccatggcttagaatgtcttgcatagcctaggcttcctgcaaaaccctctgatttcccctcctaccattcatctgctgattctgttgtcctaccccgttgatcaacttgctcttccttgaactcaaccatgttctgactcagggctttgtcactgccttttttcctcagtctaaaatgctctttccccaaaagccatagggtttatgctctcacttcctttggctctgttcaggagtcatcttagcaatgaagagcttttttccctaaaatatttgataacagtcccccttcccaacctgacactccgtgtacttcttaacctgctttgattttcagtgtgtaatatattaccctctgaaatactacatatttgtttactagcttattttgtttctagaagacaatttcttttggcagagatatttcgacctttttttcccttttgtttgactcttttgttcacttttgtgtgtccaatgcctagaacattgctagcatataatagtagtcaaatatttgttgaatttataaatatgaatgagttttgaaaatcttttctcaaggttggatttttaatgggaagacataagggtatgccagtatgaaagtattgaggagaagaatagatgttatgtataagatatatttcctgcagttttaaattctgtcctaggatgatagaccaaaatgatgaaaatttgctaatgtgttatctccttaaaataaataaccacaaatgatctcagctgtgactgtttttggctaaagaattttaaattaatggtgataaggtccaacagtgtatacagttggaaaggggtagccagtgggaaaatactgggataagtgttgggactgtttttatttaatgcctttgctaatgatctggaagaaacggtgagaatctcattaattaaattcactggtttactaaattaagaagtatcaatggtaccaaagaagaaaaaaaaatacagaaggacatagaggtgtcaaagtggagataaattaattagagttccatctataaaaaaagaattcagattgaaatatttaagacatatttaaacagttctttatgctgttaatgttcatttgatgatgatgttagcattgataatgttgatgaagatattttcctttgatttctgactaatctgtgtcaagagtggctcaactgctgtcattttatgcaagaacccatcatgttggacactatgtgtagtaagggacaaatcttatttccaaactataattaaatctacatttacatatgtccagtggtattagatagcgatggttcacatgaggaagcaagtgaagcaaattcttcctatgggaagggattttgagggcagcatttacacaatgggtcaaagttagaaggagagttggttctgacctcaagacagctttcaggttatattctgccccagcctccatggatttatttctgaatcccagtgtaaatttttcacagtgttcattaaatctgttaggtcaaatcttatataatcggccataaatggtcagatattggtaatttcttgtggctgaactaatgtgctgtttggtataagaactttgaagttgcaaggtaatagctatcctgcttctccaggtactcatttctactcacaagagaccctcccagcttcagttcagacatcaggaactgctggtgagcagcaaatgcagtgctcatttctgctaagcatggaaacttatagtaagagttagcagctggaagaagacagaaggaaaataaatttcaagaagtgcgctaaggttgtgtgtagtggctcattcctgtaatcatagctactggggagactgaggcaggaggatcacttgagcccgggatttcaagactgcggtgagttatgatgttgccactgtactccagcctgggtgacaaagtgagacactatctcttaaaacaaaaagaaaaaaaagtgtcttagaagactaacttatagattaaaagacttaaggattccttaaagtatttaagtattaagtatttaaggattccttaagtatttcaggtaagttttagtattgatgatatttggggtctatttataatactatttataattcttattttcatgtttatattttgccccaggctgttataaggttgaaaatatagttatacataggaacaaaagcaaggcagaaatagggcctgaaggacttcagaaattctgtgatttggttttaatctgtaattgccctgcttctcctgcctggtctcctgtaaaatgtatctatggcagcaggtaatattctcaggcaaaatgctgcttaattctgaactatagaaagttcagaattaaggtggaaacataatattgttagtgttgatgttattgtgtacatatatgggagcatttaggaaaatacactgttggagctcttttggactagcatgcttataaaaccatgtgttctctatcaggtgagccagtaaagctttctgactcctagcattctgcagccttagatggaatgatgcacaggagaaatgcatgcaaatgtgcacaccagcattccatttagagtgtccctgttttgtaccacatgtgagggacatcaggcaacacactatatcactctgattctcagctacctaacctgtaaaatggcagaattgcaccagatgctgtgaattgtgtttttttccaaccataatattctttgcactatatactgatacttttagtggaatattacatgtcctctactggaatattatatgtcctctacatattttgattcagcagagagtagttttgtaagtgaaataataaaaacttcagctacaaattactaataacaataactaatagtgactatttaataatgagtggttactatgtgccagtagtcatgctaaggattatcatgtatcttctgagatttctttgagcagtgtttaaagaaatcagagaagacacaaacaaatggaaaaacatcccatggtcatgaatagaaagaatcagtatcattaaaatggctacagtgtccaaagcaatttacagattcaatggtgttcttatcaaactaccaatgatattcttcacaaaactagaaaaaactactttaaaattcacatggaaccaaaaaaagagcctgaaaagccaaagcagtcctaagcataaagaacaaagctggaggcaccacattacctgacttcaaactatactaccagacgacaataaccaaaccagcatagtaatggtacacaaacaggcacatggcccagaaataaggcttcacatctatgatcatctgatcttcaacaaagctgacaaaaaaaggaaatgaagaaaagactccctattcaataaatggtgctgggacaactagtcatgtgcagaatattgaatctgaaccctttccttataccctacacaaaaagcgattcaagatggattaaagagttaaatgtaaaactccaaactacaaaaaccctggaagacaaccaaggcaataccatcctggacatattaatggaaatgagcaaaaatttcatggcaaagacaccaaaagcaatcacagcaaaaggaaaaattgacaagtgagatcaaattaaacttaagagcttctgcacagcaaaagaaactatcaacagagtacacagacaacataaagaatggtagaaaacttttgcaaactatgcatctgacaaaggttttatgtccagcatctatatgaaacttaaacaaatttacaagagaaaaacaactccactaaaaagtgggcaaaggacatgaacagacacacttctcaaaagaagacatgtatgcggccaacaagcaaataaaaaaagctcgatgtcactcattagagaaatgcaaatcaaaaccacaatgagataccatcacacaccagtcagaatggctatttttaagaagtccaaaaataacatgttggcgaggttgtagaaaaaacagaattcttattcactgttgatgggagcataaattagttcaaccattgtggaaagcagtatggtgattcctcaaagagctaaaaacagaactgctttcaacccagcaatcccattactggatatatatccagaggaatagaaatcattttactataaagacacattcatgtgaatgttcattgcagtattattcacaaaagtgaagacatggaattaacttaaatgcccatcaatgacagattaggtaaagaaaatgtggtacatacacaccatggaaaactaggcagccataaaaaagaatgagatcctgtattttgtgggaacatggatggagctagaggccactatcctttgcaaactaatgcaggaatagaaaaccaaataccacatgttctcacttacaagtgggagctaaatgataagaacttaggaaaacaaaaaaggaaacagacactggggtcgacttgaagggggaggggtggcggagggagtggaacagaaaagataactattgggtactgggcttaatacctgtataataatctgtacaacaaacacctgtgccacatatttacctgtgaaataaaccttcacatttacccccaagcctaaaataaaagttaaaaaaagtttatgaattgtttgatttaaaccttaaatattgttagggttcattcacttctcttaataaattgtagagaacatggtcgtgaagatcatggctgggagggttagaattagaactcagagctcccgagtccttttgaaatttttatcattaccctgcctgatgacaaacactgcctttttctgccatagagagatgcgttcctacctgtcttataatggaaaatgcaatgaagaaaacagaaataaggaagaaatgtaattgcaatacataattacaggctgtgatttttaaatacatattcataaattgaagcagtaaggtaagatggcttttcttcttgcacaaccagaaagatgccatcaacacaatccactttatctttttctatacatcaaataaagaaatagaaggtagattaactttatcaagatcccctattgctagtctatctaaaaacactgtctaaaaggtcagttatagcgctatctccctgactttccatcgtgcttaattttatgatgaacacctaagagaagtatgatatattaaagcactttctccattctttaaaacatcaaaacacagtgtttggaccattgatttttatccaagtgtcctctccttagtatttcagaagctttattcaaaaaaagtaattggtagttgcagcctctttattctcacagctgccaaatttctctaatctggagtagatagtcaaccatccttaacaggtgattcatagcaaggcaaaaagtgctattggacacctggagagtgaagttaagtgcaatgtattgagcagctgagaacatttcttgacagattttgttttaggtaaaaatgtgaggcattttcttttagagatttctgaaaacatatattgtaagggaaagaaaatccatatggtattgatttatttaaatgtttcaaaaattagatattgggaaagcctcttgtatttatatttttcttagagagggaacattttatttcaccaagaataaaaagaaaaaaaaagcctgaaattcatgtttagttccaaatttaaagtcggaattgacatggttttaaaaacatgaccaaacaaaaataagtttgtagtttcaaagaataatgtacgctttagaatgaagcaggcaagctgtttctctggaagactccttattcccttagtcaaaacagagcagcaaacaaataaacagtagtagcaccaaatggtagttgggtataaaactctactgaatttacagcttcagtgatacaagactggatatcaattcatggtttctttttccttatatgcaacaaaacaaaagaactcttaacaggagtaatgaatcgtctgggctgtaattgctatcctgttggtaagtgttacttgcttacaatgcttcagtgttagctggaattaggttgtactctgtagcctactaatccatacttattactaaacagaggagaaagggggctattaccaccttccagaggtgtttttaaaaagcatctttaccctggatgcacatctgaagtgttaacctggttttacccagttttgaataatttttgtaactactaaaaatacaaatgcttaagtctcacaatatgaggtatagggttatcttatataaataatatttagggatttgttatacatctcagatatggcactgagaatttagaaacactgattttttctcattagacttctttatctttattaccttgacctttgctctcaaaacttttctaatcaaaacctgttaatttttttaatccccagctttatcgaggtttaattgacaaaatagatacattcaacatgtgcagtgtgatgatttggtatatgtatacattgtaaattatcacaaattaattggtatattcatcacctcacatagatgccatttttttgtgtgtgtgcatgcaagtgtaataaggaatgatcttcctagcaatatgacagtattattatagtcaccatgctgtatattagatcctcagaagtattcatctcataagtgaaagtttttatgtaccctttaaccaatatctcttcatttcccctactctaggccactggcagccattgttctactttctgcttctatgagttttacttttttagattccacatataagtgagattttacagtattcatctttctgtatctggcttacttcactaaaaataatgtcctctaggttcatccatgttgtcttaaatggactttcttctttttaatggcttaataatattctattgtgtatacacatgtatacacacatcacattttctttattcagctattgatggacttagattatttctatatcttgattattatacataatcctgcagtgaatatgggaatgctgacatctcttcaaaatactgattttacttcttttgtatatgcatatagaagtggaaatgctggatcatatggtagttctatttttaattttttgaggaaccttcacacttcatgcccttcatacttcatacccttcataagcaccaagagtgtgcaaggattccctcttctccacatacccaccaacacatatctcatctttttgataatagccatgccagcaagtgtgagttgatatctcattatgggtttgatatgtttttctctaatgattagtgatgttgagcacattttcataaagttgttgggcatttttatgtcttctctggaaaaatgtctgttcaagtattgctcatttttgaaaaattggtttattagatatgacggataaatatattatcccattacatagcttgtctcttcactctgttgattgttccattagctgtgtagaaggttttcagtttgaggtaatgccacttgtctatttttgcatttgctgcctgtgttttttatgtcatatccaaataaatatggccaagacccatgtcaattagatttttttccctatgttttcttctaggagttttatagtttcagatcttacatttaagcctttaatccattttgagcttatttttaaaatacgtggtgtaaaataaaggtcaaattttattattttgcctgtgaatattcacttgtcccaataccatttatggaagagattgtcctctgctgtttgcttattcttggtgctgtcatcaaagattagttgactgaatatagttgggtttacttcttggctctctactttgtgtcactggtctatttgtcagttattatgccagtaccatactgttatgattacaataactttatactatagtttgaaatcaggaagagtgatgccttcagctttcttcttatgtttttcaaaattgctttggctgttcagtatcttttatggttccatgtacattttaggatcttcctttctatttctgtgaaaattgccattggaaatgtgataggaattttgttggacttacagattactttagagagtgtggtcattttataatatcagttctccctgtccataagcatggagtatctttccatttacttgtatcttctttaatttttttatcaatgtttcctatttttcagtatatagatttttcacctcattggttaaatgtattcctaaatattttttcatgctattgcaaatgggatttttctcttattttttcaaatagttattagtgttagaaatgctactgatttttgtatataaattttgcatcctgcaaatttactgaatatattctaacagttttttgggagagactaggattttctgtatatgagatcatgtcatctgccaacacacacaatttaacaaatattctgatttgcatgccctttattccttttcttacccaatttctgaataggacttctagctccatgttgagtagaagtggcaagggtagttaccgttgtcttgttcctgatcttaggggaacaattcctgccttccagtaaaaaaaaaaaaaatctcacttggtcatggtgtatgatccttttaacatgctgttgaatttagcttgacagtgttttgttaaaaatgtttgtatctatgttcatcaggaatatagcctctaattttcttttctatatcattttttatatggcttagatatcagggtaatgctggccttgtagtttggaagttttccctcctcttaaattttttttggaagagctttgtaaggattggtgttaattcttttttaaatgcttggtagagtttacctgtgaagccatcagatcctgaacttttcggtgttggaaagttgtaaattaccgagtcaatctccttatttgtttttagtctgtttagattttctattttttcatgattcaatcttggtaaattgtaaatttctatgaagtgataccttttttctaagttatcctattagcatataattgttaatggtagtctcttacgattctttgtatttctatagtatcggttgtaatgtttccccttttacttattatgttatttatttcattccattagtctagctaatgtttgccaattttgttcatcttgtctaaaaaccaattcttagttttcttgctcttttctattgtacttctcatctctatttcacttatttctgctctgattgttattttcttccttgtgctgacttcagtcttagttcttctttttctagttccttgaggtgtcaatttggcttgagatctttctttttttaacgtatgcatttattattataagcttccctctttacatggcttttaatgcatcccatacattttgatatgttccttttccattttcttttctcttaagatgcttttttatttctctattgattttttctttaacccattggttgttcaggagcattaatgttttctttccacatatttttgaattctttaattttcttcttgttattcctttttttttttttttttttttttttagctttaagttccgggacacaagcgcagagtggtttgctgcacctatcaacccatcacctaggttttaagccctgcatgcattagctatttgtcctcatgctctccctccccggctccacaccccaacaggccctggtgtgtgttgttaccctccctgtgtctatgtgttctcattgttggactcccacctatgagtgagaatatatggtgtttggttttctgttcctgtgttagtttgctgaggatgatggcttccagcttcatccatgtgcctgcaaagacatgttctcattcctttttgtggctgcataatattccatggtgtatatgaaccatattttctttatccagtctatcactgatgggcatttgggttggttccatgtctttgctattgtgagtagtgctgcataaacgtatgtgtgcatgtatctttgtaatagaattatttatattcctttaggtatatacccagaatgggattgctgggtcaattggtatttctggttctagatccttgaggaattgccacactgtcttccacaatggttgaactaatttacatttccaccaacaatataaaagtgttcctgtttctccacagcctcgccagcatctgttgtttcttgactttttaataaatgccattctgactggtgcgagatggtatctcattgtggttttgattggcatttctctaatgaccagcgatgttgagtttttttttttttcatgtttttggctgcataagtgtcttcttttgagaagttcctgtttatatcctttgcccactttctgatgcaaattctggatattagccctttgtcagatggatagattacaaaaattttctccaattctgtagattgccagttcactctgataatagtttattttgctgtgcagaagctgtttagtttaattagataacgtttgtcaatttcaacttttgttgcagttgcttttggtgatttcatcataaaatctttgtccatacctatgttctgaatggcactgctaggttttcttctagggtttttatgggtttgggttttacttttaagtctttaatccatcaggagataatttttatataaggtgtaaggaaggggtccagtttcagttttctgcatatcactagccagttttcccagcaccatttattaaatagggaattctttccccattgcttgtttttgtcagattcattgaagatcagttggttgtagatgtgtggtcttatttttgaggtctctattatgttccattggtttatatgtctgttttgttaccagtaccatgctgttttggttactgtagccttgtagtatagtttgaagtctggtagtgtgatgcctccagctttgttcttttttcttatgattgtcttggctatgtgggctcttttttggttccacatgaattttaaagtagttttttctgattctgtgaagaatgtaaatggtagtttgatgggaatagcattgaatctgtaaattactttggacagtatggccattttcataatattgattcttcctctccatgagcatggaatgtttttccatttgtttgtgtcctctcttatttcctcaagcagtggtttgtagttctttttgaaggggtccttcacatctcttgttagctgtattcctacgtgttttattctctgtagaaattgtgaatgggagttcattcatgatttagctctctgcttgtctattgtggttgtaaaggaatgcttgagatttttgcacattgattttgtatcttgagactgctgaagttgcttatcagattaaggagttttggggccaagaagatggggttttctacatgtaggatcatgttgtctgcaaacagagaaaatttgacttcctctctacttatttgaatgtcttttatttctctctcttgcctgattgccatggccagaacttccaatacaatgttgaataggaatggtgagagaggacatctttgtcttgtgccagttttcaagtggaatgattccagcttttgatcattcagtataatattggctgtgggtttgtcataaataaatcttacgtttttttagctgtgttccatcaatacctagtttgagactttttaacaggaaaggatgttggattttactgaagactttttctgcatctgttgagataatcatgtggtttttgtcatggttctgattatgtaatagattacatttattgatttgcccatgtggaaccagccttgcatcccagggatggagccgacttgatcgtaatggataagctttttgatatgctgctggatttgatacaccaatattttattaagggtttttgcatcaaagttcatcagggctattggccttaagctttcttttttgttgtgtctgccaggttttggtatcacgatgatgctagcctcataaaatgagtttgagagaagtccctacttttcagttgtttggaatagtttcagcaggaatggtaccagctcctctttgtacctctagtgaaatttcgctatgaatccatccggtcttgaacttttttgtttgtttgttttgattggtaggctatttagtgctgccttactttcagaacttgttattggtctattcagggactccatttctttctggtttagtcttgggacggtgaatgtgtccaggaatttattcatttttctagattttctagtttatttgcatagaggtgttcatagtatcctctgatgctagtttgtatttccgtggggtcagtgttaatatcccctttatcattttttatagtgtctatttgattcttctctcttttttatctttaggtaatttttttgagatggagtctcactctgtcacccaggctggagtgcagtggtatgatctcagctcactgggacctccacccaccgagttcaagcaattctcttgcctcagcctcccgagtagttaggattgcaggcacctagcaccatgcccagctaggttttgtattttcagtagagacggagtttcaccatcttaaactcctgacctcatgatccatccacctctgcctcccaaagtgctggtatgacaggtgtgagccaccgcacccagtcaattcttctctcttttcttctttattagtctagttagtgatctattttatttattttcttttcaaaaagacagctcctggattcattaattttttcaagggattttcacgtctctgtctccttcatttccatgctgatcttagttatttcttgtcttctgccagcttttggatttatttgcttttgcttctgtagttcttttcattgtgatttaaggtctttctagatttctgatgtggacatttaatgtggacatttccctcttaacactgctttagctatgtcccagagattctgggacgttgtctctttgttctcactggtttcaaagaacttctagatttctgccataattttattatttactcaggagttcattcaggagcaggttgttcaatttccatgtggttgggtagttttgagtttcttaatcttgggttctaatttgattgcagtgtggtctgaaagacttctaatttcagtaattttgcatttgctgaggagtgttttagttccaattatgtggtcaattgtagagtaaatgccatgtagcactcagaagaaagtatattctgttgttttggtgtaaagcgttctatagatatctgttaggtccacatgatccagaggtgagtctacatcctgaataacgttgttaattttctgtcttgttgatgtgtccaatgttgacagtagggcgttaaagtctcccgctactattctgtgggagtcttctgctttccgcttgcttagtaaattttcctccatcacgttattttgagcctgtgtttgtctttgcacatgagataggtctcttgaatagagcacaccttgaaacctgactcttcaatcaacttgccagtctgtgtcttttaattgaggcatttagaccatttatatttaaggttagtatttttaatgggtgaatatgatctctcatcatgatgctggctggttattttgcacaatagttgatgctgtttcttctttttttaaattatactttaagttttaggatacatgtgcacaacgtgcgggtttgttacatatgtatacatgtgccatgttggtgtgctgtacccattaactcgtcatttaacattaggtatatctcctaatgctatccctcccccctctgcctaccccacaacaggccccggtgtgtgatgttccccttcctgtgtccatgtgttctcattcttcagttcacacctatgagtgagaacacgtggtgtttggtattttgtccttgtgatagtttgctgagaatgatggtttccagcctcatccatattcctacaaaggacatgaactcatcctcttttatggctgcatagtattccatggtgtatatgtgccacattttcttaatctggtctatcattgatggacatttgtgttggttccaagtctttgctattgtgaatagtgctgcaataaacatacgtatgcatgtgtcattatagcagcatgatttataatcctttgggtatatacccagtaatgggatgactgggtcaaatggtatttctagttctagatccatgaggaatcgccacactgacttccacaatggttgaactagtttatagtcccaccaacagtgtaaaagtgttcctatctctccacatcctctccagcacctgttgtttcctgactttgtaatgatcgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgctcactttttgatagggttgtttgatttttttcttgtaaatttgtttgagttcattgtagattctggatattagccctttgtcagatgagtagattgcaaaaattttctccatttctgtaggttgcctgttcaccatgaaggtagtttcttttgctgtgcagaagctttttagtttaattagatcccatttgtcaattttggcatttgttgccattgcttttggtgttttcgacatgaagaccttgcctgaatggtattgcctaggattttgtctagggtttttatggttttaggtctaatatttaagtctttaatccatcttgaattaattttagtataaggtgtaaggaagggatccagtttcagctttctacatatggctagccagttttcccagcaccatttattaaatagggaatcctttctccatttcttgtttttgtcagatttgtcagagatcagatagttgtagatacgtggcattatttctgagggctctgttctgtttcattggtctatatctctgttttggtaccagtaccatgctgttttggttaatgtggccttgtagtatagtttaaagtcaggtagcgtgatgcctccagctttgttcttttggcttaggattgacttggcaatgtcggctcttttttagttccatatgaactttaaagtagttttttccaattctgtgaagaaagtcattggtagcttgatggggatggcattgaatctataaattaccttgggcagaatggccattttcatgatattgattattcctacccatgagcaggaaatattcttccatttgtttgtatcctcttttatttcgttgagtagtggtttatagttctccttgaataggtccttcacatcccttgtaagttggattcctaggtattttattctccttgaagcaattgcgaatgagagagttcactcatgattcagctctctgtttatctgttattggtgtataagaacgcctgtgatttttgcaaattgattttgtatcctgatactttgctgaggttgcctatcagcttaaggagattttgggctgagacaatggggttttctagatatacaatcatgtcatctgcaaacagggaaaatttgacttcctcttttcctaattgaataccctttatttccttctcctgcctgattgccctggccagaacttccaacactatgttgaataggagtgatgagagagggtatccttgtcttgtgccagttttcaaagggaatgcttccagtttttgcccattcagtatgatattggctgtgggtttgtcatagataggtctgattattttgagatgcgtcccatcaatacctaatttattgagagattttagtatgaagggttgttgaattttgtcaaaggccttttctgcatctgttgagataatcatgtggtttttgtctttggttccgtttatatgctggattatgtttactgatttgcatatgttgaaccaaccttgcatcccagggatgaagcccacttgatcatggtggataagctttttgatgtgctgctggatttggtttgccagtattttattgaggatttttgcatcaatgttcatcagagctgttggtctaaaattctttttttcttgtgtctctgccaggctttggtatcaggatggtgctggcctcataaaatgagttaaggaggattccctgtttttctattgattggaatagtttcagaaggaatggtaccagctcctccttgtacctctggtacaatttggctgtgaatccatctggtcttgggctttttttggttggtaagctattaatttttgtctaaatttcagagcctgttactggtctattcagagattcgacttcttcctggtttagtcttgggaaggtgtatgtgtcggtgtcgaggaatttatccattacttctagattttctagcttatttgcatagaggtgtttatagtattctctgatggtagtttgtatttctgtgggattgaaggtgatatcccctttatcattttttattgcatctatttgattcttctctcttttcttctttattaatcttgctagtggtgtatcagttttgttgatcttttcaaaaaaccagctcctggattcaatgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgctgtgtcttttttctcattggtttcaaagaacatctttatttctgccttcatttcattaggtacccagtagtcattcaggagcaggttgttcagtttccatgtagctgagtggttttgagtgagtttcttaatcctgagttctactttgattgcactgtgttctgagagacagtttgttataatttctgttctcttacatttgctgaggagtgctttacttccaactgtatggtcagttctgctgagaagaatgtatattctgttgatttggggtggagagttttgtagatgtctattaggtccacttggtgcagagctgagttcaattcctggatatccttgttaactttctatctcgttgatctgtctaatgttgacagtggggtgttaaagtctcccattattattgtgtgggagtctaagtctctttgtaggtctctaaggacttgctttatgaatgtgggtgctcctgtattgggtgcacatatatttaggatagttagctcttcttgttgaattggtccctttaccattatgtaatggccttctttgtctcttttgatctttgttggtttaaagtctgttttatcagaggctaggattgcatcccttgcctttttttgttttatttatttgctttatttatttgttttatttgttgatttgctttatagattttcctccatccctttattttgagcctgtgcgtgtctctgcatgtgagatgggtttcctgaatacagcacactgatgggtcttaactctttatccaattggccagtctgtgtcttttacttggagcatttagcccatttacatttaaggttaatattgttatgtgtgaatttgatcctgtcattatgatgttagctggttattttgctcgttagttgatgcagtttctttttagccttgatggtctttacagtttggcatgtttttgcagcggctggtaccagttgttcctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcccccactctcttctggctggtagagtttctgcggagagatcagttgttagtcttctaggggttccctttgtcggtaacccgacctttctgtctggctgcccttaacattttttccttcatttcaactttggtgcatctgacaattatgtttcttggagttgctcttctcgaggagtatctttgtggcattctctgtatttccttaatttgaatgttggcctgcctttctggattggggaagttctcctggataatatcctgcagagttttttccaacttggttccattctccccatcactttcaggtacaccagtcatacgtagatttggtttttttcacctagccccatatttcttggaggctttgttcatttctttttattctttttctctgaacttctgttctcacttaatttcattcatgtgatcttccatccctgataccctttcttccagttgatctaattggctcctgaagcttgtgcatttgtcacgtatttcttatgccgtggttttgagctccatcaggtcctttaaggacttctctgcattggttattctagttagccattcatctaatcttttttcaagatttttaacgtctttgccatgggttcgaacttcctcctttagctcagagtagtttgatcatctgaagccttcttctctcaactcgtcaaagtcattctctatccagctttgttctgttgttggtggggaactgcgttcctttggaggaggagaggcactctgatttttagagtttccagtttttctgctctgttttgtccccatctttgtggttttatctagctttggtctttgatgatggtgacgtacagatggggttttgttgtaggtgtcgtttctatttgttagttttccttttaacagtcagaaccctcagatgcaggtctgctggagtttgctggaggtccactgcaaaccctgtttgcctgggtatcagcagcggaggctgtagaacagcggatattggtgaacagcaaatgttgctgcgtgatcattcctctggaagttttgtctcagaggagtacccagctgtgtgaggtgtcagtctgcccctactggggtgtgcctcccagttagtctacttgggggtcagggacccacttgaggaggcagtctgtcctttctcagatctcaagctgcatgctgggagaaccactactctcttcaaagctgtcagacagggacatttaagtctacagaggtttctgctgccttttgtttggctatgccctgcccccagaggtggagtctacagaggcaggcaggcctccttgagctgcggtgggctccacccagtttgagcttcctggccgctttgtttacctactcaagcctcattaatggcgggtgcccttcccccagcctctctgccgccttgcagtttgatctcagactcctatgctagcaatgagtgaggatctatgggtgtaggatcctccgagccatgcgcaggatataatctcctggtgtgccgtttgctaagaccattggagacgcgcagtattaaggtgggagtgaccagatttcccaggtgccatctgtcacccctttctttgactaggaaagggaattccctgaccccttgcgcttcctgggtaaggcgatgcctcactctgcttcggctcactctctgtgtactgcacccactgtcctgcacccactatccaatactccccactgagatgatcccggtacttcagttggaaatgcagaaatcacccatcttctgcgttgctcatgctggaagctgtagactggagctgttcctattcggccatcttggctccaccccccgatgctgtttcttcatagtgtcattggtctttatagtgtcatgtgttttgcagtagctggtaccagtttttcctttctatacttagtgcttccttcaggagctcttgcaaggcatgcctggtggtgacaaattcccttagcatttgcatgtctgaaattgatttaatttctccttcaattacgaagattggtttggccagatatgaattgtgggttgaaaatgcttttctttaagattgttaaatactggcccccattcttttctggactgtagggttttgcagatagatccactgttagtctgatgggcttccctttgtaggagacctggcctttctttctgggttcccttaacattttttccttcatgtcaaccttgtagaatttgatgattatgtgtcttggtgttgatcttatcatggagtatcttttctggattctctgtatttcctgaattttcatgttggcctgtcttgctaggttggggacgttctcctggatattaccctgaagtgtgttttccaccttggttccattctccatgtctttttcaggtactccagtcagttttagtttagcctttttacatagtcccacgtttctcagagtttttgtacattccttttcattcttttttctgtcatgttgactgcctgccttatttcaacaagatagtcttccacctctgatactctttttttgcttgattgatttagctattgatacttgtgtatgcttcacaaagttctcatgctgcatttttcagctccatcaggtcatttatgttcctctctaaacgggttgttctagttagcagctcctctaaccttttatcaaggttcttagcttccttgcattgcattagagcatggtccgttacctctgtgaagttcgatattacccaccttctgaagcctacttctgtcaattcatccatctcatcctccgtcctgttctgtgcccttgctggagagatattgcagtcgttcgaaggagaagaggcactctggcctttccggctttcagtgtttttttgttgttgttgattccttctcatcttcatgagtttgtctagtttgtatctttgaggctgctgatcctttgatgaggtttttgtgggagctttatttttgtttgtttgctgctgctgttgttgctttctgtttgtttgacattctttcaatagtcagttccctcttctgtagggctgctgtggtttgctggggttcacttcaggcactattcatctggttcactcctgctcctggagatatcacttgaggaggctggataacaggaaagatgggttcctgctccttcctcttggatctctgaccttgaggggtaccaacctgtttcagtaggaacactcctgtatagggtgtgtgacaacccctgtttggggtgcctcacccagttgggtggcatgggaagcaagacccatttaatgaggcactttggctgttccttggtggaagacgtgggaaacccacttgtctgggctgctgggtttcctcagagctagcaggaggaaagactaaatctgctggtctgtggagactgtgcacacccctcctcctaggggctcaggcccagggagatcagaattcattccctgagcccctggctagagatggagttcctgcagagaggccctgcatccacagtgttggctacggcctcccttcaaggagctcagatggcttagagagcaggcagctgcagcagtggtgatggctgcccctccccacaagtaatttgcaggcttaggctgattctagctgagtggctgttgagaatctttgcagctccatggttacaacccaaggctttggtggcataggatcatgagtgggatcttccaatccatgggttgcacagtcccttggtaaaagcacagtttcccaggctgagtagcacactcactcacctcctcacttgggtgccctttgtggctctcaggtgggctgccacaccacagtgcccttccttcctttctgtaagtcatgccagctgcctagtctgtcctaatgacagaacctggatactttggcttccagtgcaggatttgcatgctgttttagatcttttcaatgggagcctctgattaccactgcttctagttgtccatcttggccccaccccactccttgttattgatttctagtttcataccattgtgctcagaaaagatacttgatatgattttaattttcttaaatttgtaaaaactttcctggaccaacgtatgacttctcctggagaaaggtagtgtgtgcttgagaagaatatgtcctctgctgctattgaatgaagtgttctctatatgcctgttaggttcatagcggtatttaagtctgcttttttttgcatttattttctatctgcatgatctacccatggttgaaagtagactattaaggtcctgtactatattttattgccatgtctcccttcagctcagttaatatttgccttatatatttatgttctctgatattgtgtgcatatatacatatatatatacacacacacataattattataatctcttaacatatttttagtatagattggccttatttttctttttttaacagatttttcctgaaaatctattttggctgatataagtatcaccactctctctcttttggttaccatttacatggcagatatttctcatcccttcactttcagtatatgtatgcccttaaaggtgaatctgagttgctcatagcagcaccattttggatcttgttttttaatctattcagctactctgtgtcttttgattagagaatttaatttatttgcacttaaagtaattattgacaggtagagactttttatcattttgttaatttttttctcattgttttgtatttcctttgattctttatcttttgttgtattcctttgaaatttgttgtttttattctagtattatgctttgaatcctttttctctacagttttttctatccactgaaggttttgtgtgtgtgtgtgtgtagttaccaagaggcttaagtgaaacatgttatagttataatgttctattttaaactgataacaagttatccatttaaactctataattttacttctcccccttacaaattatatactattaatgtcactccttacatctctttatattgtgtgtccattaaaaattcatgttattatagttactttcaaatttctgcttttagtttttgtaccacagttaaaaagtaacatccagtagtttttcctacctgtgggagacatatttcaatatctccagtggatgtctaaagcagtagagagtgccaaactctatatatacagagaaagattgtttggaaggctaagtcttccctcttaataagtaaaggtttttgctttataaaaattttttgagtcattttgcctaaataaatgacttatggtaacctggaattgtatttgataatatcaattgttttaaaccattaacatatttgataggcttcccgaaatcaaacttcagcttcaaaaatgtcttttctgacccctaactttggaatgctacagagagcccctggagcatccaaaagagaggtaaacaggattatttgacatgtttagtatgcggctcatctgtagcagctgctgtgaagacactgactgcagcagtgtaggtgtggctggggttgcatgctcaaaagggccagcaagaaccaggaatggggaaagccccacccactatggagttggaggggcaggagccccatgccctctccaggtgcagctgcagcgacctagccatgactctggatctggttatccctctgctctcaggggcgcaggaagcccctgcccctgaaggcttggaagtgcctgctttcactgtctcacctctccccactcttggcacctactctggtgtggagcaaagttgtggtcgagcctgggcactcttgtgacccaactgggtgtgtgagtgcttgagatggcactgacatgccaactccctgccacctcagcttcctctggactttgggtgcccgggagcaaaggagggaggcctgcaggttcccctcagcacaaatgacctgggcatcattgatagcatgttgatggtgtgaggcagacaggttcctgcatggaaagaggcaggtctccagtaaaaccccaccttcaagccagggatggcctgaagcctggaggccaggctgccaatttcaagtagagttgctgaccaggagtgagaacttatggtcttctcccaggcctgcccatggctgcccattgaccaatcagcacacacctcctctcttttgagcccataaatacccttgactcagccagactcacacagacatcaggactaccagctacaggaaggagctatccattttatatctcctcaactcatcaagatgacctgtgtgtagaaacgtgctacccactattggtctcccctttcccgagaggtggacactaagacagatgaccttcctgaggaaaggagctactcactttgggtctcctgagaactgttctgctgctcagtgaagctcctgtccaccttgctcatccttcagttgtccacatacctcattcttcctggacatgggacaagaacttgggacttgccaaatgttaggactaaaagagctataacacaaacagtgctgaaacgtgctcccctgctcacaacgttgtgggtgacaagaaggagaaaacagctgcggcccttcaaggaattcagacctatgtgatccctgagtcaggactgtgacaccctctttggggctctgtggatcctggtatctccaagcttttgggcaccaccacattccctagtgcccacagcagaagccacttgcagtacacctggtccagccacagcctcacatgaagccagcaccagtgttggtgcctggagctgcctgccctgccacagctgtgtgcctggctgtgtgcagtggctgaaccccatgctcaattgctcacacagcagtcactgctctgtgcctagttcacccttggcaaatgtgggattcaggccagtagcaagaggtgagtgcagcctgccaagcctagtcagtagaaggagcccagtagaagtgagcaaaacccaagcaaagatgccaccggagacagaggtttctggctggccaagtgaagccctaaggacactgtgacaataccttttacaattaagcatacatacctatgataaagtttaatttataaataaggcacaataaaagattaacaaaaataataaaagagaacatttataacagtttaagaaactctatagatatggcttccctctatctctcttaaaatatattattgtactataccatgggtaattgaaactatggatagcagaactgcagataagaagggattactgtacacaccacaattactttattacagaattctgaaatttgctatgtatttaaccttaccagtgagttttatactttcatatgttttcatagtattatataatgccctttatttaaatttgaaaacgctttttagcatggtttttaggacatcctatatttataatagtccttcaacttttacttttctgagaatgtttgcatctctcttttatttctgaaggacagctttgccatgtataatattattagttgacatttttttcttaacaacactttgaacatagcatccaactcacttatgaccttcacagttgctgtagagaaatccactgatagccttaggagtttttgcttgtatgcgattagtctcttttgctactttccagatcctctcttatattttaatttgaatgccatttttcccccaagattaggaaaattttcagtcatcagttatttaaatacatttttctgctcctttctctttactttttagactctcttaatttatatattcattttcttgatcatggcccataagtccttttgcattcttcagcattttacgttccttttgtttggctcttctaatagcctaatttcgactaacctttcttcaagttccttgattcttttttctgcatttttgagtctactgttgaaacactctattagattttccgttctgtcattgtattcttcatctccaatatttgtgtttggttctatttttatggtttctatttctttattaaactttttatattgtttatacacttaaatccctcagatactgttgtttatttgggttctcttgcatcacgctgagcttctttaagataattgtgaattatttgtcatacaattcatagatctccatttctctggggttggttattggaacgttattagtctcttttgatgttatatttgcctacttgttcattatcagtgcagctctgctttggtatttgtgcatttgaagaagcaaacacttcctcctgtttttacagactgatttaggcaagtaaagacctcttcctttgggtctctggcctaatgagattgcccccaagaatcacagttgagtaggattggtgctaggtcacatgggtgctgcagaatctacagtgggggctgtggatgatgaacctattaccagagtctcaaacggacatgaatcttgtctgttttctgggaaaactggactgactgtaagtctttggtcaataggctggcactaggaaatgggtacttttcaggatccgcagttgtgtctgcaataggtgcataggaagatgtccttccttctgggtccctgagtgagctcctactgggtcactgaatgagttcctggacaggaaggactggccctgaaacatagctgagaggggctaaaactagtcataggggtgtttcaggcttcacagtttagactgaggtctgcaagcctctctctaggggcacaggcatatatgcttttataggtcctgggggacagaattgcccctagactgtggctgaatagagtcaggccacaggatgcttcaggatctgcagtgagattcaggctggtgggccttcctctaagagaagcatggaatggtgtgtctcctggcaggtccatgtgagagcagcactaatctatggctagagctaaaaggggctggaacttagttaccaagctgtttcagaatctgctgtgggaccaaagctcagcagccttgtctcagggacatgaatctgtgtgttttcctgtgggttcctgagcatataggactgctatcagtctgtagctgagaggggctggagcctttgcaggctcatatctgggactgaggttggtggacctgtcactgaaggcatgggtgggcatgactcttccctcatcccttggctgatggttctggtggcagaaccaaggacaattggaactggagctaatctacagggagttgaggctgtttccaggtttgtaatcatgaccacaggtggtgaacctgccaactgggtgtggacttgttctttcaaaacagtcctccttagtcttgggccatactaaggtttcacaacctctgacctaaatttcaaagctcccacaaaggcactttttttcccatggatggctgccaaactattgtttctgtgagaggatatgaacagagaatctcctattctatcttcttgctctaaaacctggttactttattttacatttattttactttgcttgaatcagcatagaggtaagagatcagtgggatgagtaaaatgacatggataaaagtcacttggcagactagaaggtaatttttaattaatagtgctcccattcgttgtcttaaaaacaaattggatctttattaattaccttgaacatttgattttctattttttccaaatatttgatgtaaaagcaaccgttctctttttcacctctaccagaaaaacttttagaatggtcctttgtctattttttaatatatgatcttaagagataaatactgtggaaagaatattaagtgtccttatatcaactaataattttagattaattgtcaaggcacaaaaagaacattttcataaagtactttattcataaatattactgtgcattcacttttatgttgtttctaacacatgtaacatagaactcaaccacttaaagtaaggagtcaaaaaagggatatgattgacctttactgagcatcaagcatgtgttagatgctttctatgtcctaatttaatttttataaacaccttaggaattaatattcccatgctacaatcggagaaaacttatacagatgaagaaactggctgggcacagtggttcacgtctataatcccagcactttgggaggccaaggtgggcagatcacctgaggtcaggagttcaagaccagccaggccaacatggtgaaaccctgcctctactaaaaatacaaaagttagctgggcatggtggtgggcacctgaaattccagctacttgggaggctggggcaggagaatctcttgcacctgggagaggttgaagtaagccgagactttgtgagacagtctgtctcaaaaaaacaaacaaacaaacaaaaaaacaaatttacccatgattaaaaacgtttaaatctcagttacaaccctagatatgattgttctaaatatgtcctttctgctacttcctttgctacaaaaaaaatccaagaaatcagaaagaagtaacgcattaagtgtatatatacatacccatacacgcacataattttttcaatgaataacctatactcttcagtatatacccagtaaaatctggaaaaaaattaaaccttatccaaggtaataatcttctctctgttattattccttgtatgttgtttaaaaatctatcaattttccactcgaaatttacttctctcttaaattctttaagaattagaaacctctgattttcatatgccaaataccaggcacaaaaatgttttcttttctttcattgtggtaaatccaagtgtaatacagtaagaatggaaaatatgagtaagtgcatgtacatatataataaaattaagaaatatgtcataatattttactctttggctttaatttccattttattctggcacaaggtttgtagtggagtgggcagggagaaagaacaactagtaacatgttttaaggcaagtgtaaaagataactttaccactcacaagagttttatatccaaatttagctccaaaattaatctgagattcccagactaaaatatctgtggataattttaaagattgagtagtttgttttcttattaattttttgaaatgtgtttttatatcctggtacagagttatatattctggatataagccatttatcaggtacataatttacaaatatctcaccctgtttgtgttttgtctttttattctttgtgtatttgcaagagccaaacttactgcattttctgaggtacagtttgtcatttttatggatcattctttaggtattgttatatttaagaaatctttgactgactcaagatcacaaagattttcttctgttttcttctagaattgtttaaaattgagattttgcattttagacttactcattttgaggtaatttttccatattttatgaataatagatcaaagttattattttatatattgatatacagctttggcaaaaataaattggccatatacatataggtttatttctagagtctattatgttccattgatccatttgtctgtattaatgctgaccacattatctcgacccctagagctttaaaataaatcttgaaatcaggttgcttagctctgtactttaattctgttttaaaagttttattggctattttagatccattgcattttcatataaacttaataataaactagtttatttctaccaaaactgtcagtatatgagttgaaattatattaaagctatataggtcagtgtgggaagaattgacatctacgtaacagtaaatcttccaacccatgaatgcttaatattctatttttatttagatctcttagaatttctctaacaagtattctgtaattttcagatctggtagatttatttctaaatattacatatttgtgtattctcatcatttgcattccttaaaatatcagttttatttgttcgttactattgtacaggaatacaattgactttataaaatttgccgattagttccggggctttttaaatagattctacaggattgtctacatagacaatcttattttttgtgaataaatataattttaattattcctttacaaactaaatgttttaaaatttctctttcttgccttattgcactggttatgatgttcggtatgatgttgcatagtattgatgagagtgggcatttttgtattattcttgatattaaagagaaaacaattgagttttctatgttcagtacaacattaaatcagtatttttcatacttgttttttaaaagttaaattgatgcagttcttttttagttattattttctgagtgcttttaaaatttattgagaaatggatgttgaatgtcattttattttgctccatctactgagaatgtaatacaaatttttaaattttaatatgacaatttgtaagttatatattcttggtttctatttgctaaaattttatttagaatatttgcatctttgttcatgaagaatattagtgtgtaattttcttaacttgtaatggcttttttctgcttttggtattaggataagttttgtttcatagaatgagtttggatcattaaaaagtcaggaaacaacaggtgctggagaggatgtggagaaataggaacacttttacactgttggtgggactgtaaactagttcaaccattgtggaagtcaggtggcgattcctcagggatctagaactaggaataccatttgacccagccatcccattactgggtatatacccaaaggattataaatcatgctgctataaagacacatgcacacgtatgtttattgcgacactattcacaatagcaaagacttcgaaccaacccaaatgtccaacaatgatagactggattaagaaaatgtggcacatatacaccatggaatactatgcagccataaaaaaggatgagttcatgtcctttgtagggacatggatgaagctggaaacggtcattctcagcatactatcgcaaggacaaaaaaccaaacaccacatgttctcactcataggtgggaactgaacaatgagaacacatggacacaggaaggggaacatcacacaccggggtctattgtggggtggggtgaagggggagggatagcattaggagatatacctaatgttgaatgacaagttaatgggtgcagcataccaacatggcacatgtatacatatgtaactaacctgcacattgtgcacatgtaccctaaaacttaaagtataattaaaaaaaaaaaaaaaaaaccattgttctcaacttcgctgagtagagtgtcacatgaataagaactaggcaaatttagttgataataatgtttgagatttctttctacttacaaatattttgtttatttattctcttggttactaagagagggatgctgtcttagtctgtttgggctgctataccaaaaaacccttacctgagtagtttatatatagcagaaatttattttttacaattctggtggctagaaagtccaagatcatggaatatttcatctctggtaagggagcattttctaattcacagatgacattttttgctgtgtcctcacacagtggacgggataaagggtttctctcaggtctcttttatcaaagcaaggacagtaatttgtgagggctctatccctgtgacctaatcagctcccgaattccccacctcctatcattttgttgggcaagatttccatatatgaatttagaggacactacacattcagatcatggcagatgaagaaatttccaaatataagtaagactttatctattttttcttgttgctctataacattcgtttcatgtatctttaaactgctaccatgtgcataaacattatgatggttatgctcttccgaggaattgtctttcatgattgtcctagtttgtttgtgctgctataacttaatacctaaaagtaagtaatttataatgatcagaaatttatttgatctcagaattatagatattagaaagcccaatattaagatgctgacaactggcgaaggccttattgctctgtcatcccatgctaaaagacagaaggaccaagaaacaaaagggagctgaattcacctttttataatgacagtaatcctgcctatgagggtagaccccgcacggccaagtcatctcctgaaggtcccacctcccaacactgttacaatggcaactaaatttcaacatgagttttagaagagacaaacattcaaaccatagcaatgactaaatgaccttcatatgtacaataagtatttttgctttaaaatcttctttgatattaatggagcttctccaaatttttaaaaagaaatcactgttaacatagtttattgttcccattctttttctcttaactgtttatacctttatttttaaagtgagtttgtaatagaaagtatatagttgagtcttgttttatttatccagtccaacaatctacacttgttatttatttgttgatatgattgggttatatctagtacttcttttttattttatgctttttctatttcttcttttttctctttttctgccctattttgatgagtcgggtattttctttttttcccctcgttgcattttattttcctttcggcttaacatttatatttcttttttttgttaatttagttgttggtttggatttatagtatacacatttaacttatcaatctatcttgaaatgatattatgccactttttatatgttaaagtaactttataataatatgctgcacttattccctgtgaggctctgttctgctttttaaaattttacttttatggctgggcgtggtggctcatacctgtattcccagcactttgggaggacgaggcaggcagatcatgaggtcaggagttcgagaccagctgaccaacatggtgaaaccctgtctctactaaaaatacaaaaatgagccaggcgtggtggtgtgcacctgtaatcccagctactcaggaggctgaggcaggagaatcacttgaatccaggaggcggaggttgcagtgagctgagattgtgccaccgcactcccgcctggtgacagagtgtgactctatcccccctccaaaaaaaaataatttatatttgttatgaatctcataatacatttttattaatattcttattttgttttcaatgtcaattgtcttaacaaagatatttaacaataaaagaaatactctgtatttaaccacatagttaccattttcagagctcttcagtatttcgtttagaaatggattttcttctgacagcattaacttctacctgaaataataacgttagtatttcctgtattagttcacctagtgaaaaattctttcagctttgtgtgctcccaaatgtctttatgtcagcttcatatttgaaatactttttttgagatatagaactctagttcagagagtttttatttgagtactttaaaaacttcctccactatcttctagcttacattgtctccaatgagaaatatgttatctttgtttctatatatgtaatgtgtcttcttaatctggctgtttttaggattattttgtttttaacgctcattattactgataatgtgcttttttcattttttaaattcattttatgttggtcttcattgaactttttgtatctgtggattactgtttttatcaaattttgaaaatattcagccattatttcttcaacttttttctgttttctactctctctcttctccttttagattgcacttacatatgtcttagaccacttgaatttgccccacagttactccattttttctctctctttcgatttcattttgaatggtttctattgttaagtcttgaagtccattactttttttttagcaatatctaatccgcttctaattccatttagtataattttcatttcaggcattgtatttttttcatcttggcaaattgaatatttttaacttccataatttatttgtttcctgttgttcctcatctttttctctagtttctttaacatgttaaattgttgtaaaaatgcttttagtattctgtttattaatgttatcatctgtattgattctatattgggttaaattgatttcttttcatcttcattctgcaccttatcctcctcctgtgcatgtctcataatttttgactggttgtcagatattgtgattttagtttatttaggtccttatttttctgttgctgcatatattcctgagcttccttgtggaatgtggttcacttccttggaaatagtgtgatctttttatgtttctttggcttgaacagaacattgtttctctaaggcttttttttagtcccccaccactgaaagaaaaacatataagtactctataaaatgatgagtatattttaaaacttcatactttggcttgtgcattccagacggtattccctctaatgcatttgggtggtttcttttcaccctctgtctttcagtggttttctcaggtacgtattctggacagtattccagtttaggacacaagagtatcctctacatatatttggagctctctcattgtacaactttctcctctctgacagtctgtcctatgaactcttactttggtctttccaagcttccaactctaacaattcaactcagggaggctgtgtgggggcaactggcttctttcctggcaggtctgtcccacagaccctggccaagcaacagatgaaaggagtactcatacgcagacatgcagtgaaaaagtgggcttggggactgatggcactaggggccaaagagtgttagcagtctgataagccagagccacttgtatttattcagtagagatttaatgacaaaggcctggagccaacacaacctgtggataattaacattgtcgcctcccacccccgccccctccaccccttgcaaggagcagtcttgcgcgccgatgatcaagatgatcaaaggtcagtttctggacaacataagtaaataaacttatctagataaacttctgcacgttcttttgcacctacttctcaccctctgcctcagggtaagagaattacctgccttcagtttttattctctcctgaagctttgaaaaacctcccggccttccaagaaggtttgtgtctttccctataacttttcttataacttttcccatcatcctgacccatctcctacactttcccagtgccatagcctggaaactctcaccaggcagtaagccgaggtaatctttggggtccctggtttgtatctcatctcataggaatgactagatcattgtgttgtgtttcctaatgctcagtggcttgaaaagtattgactcatattttgttcagtttttagttgtttcatgtaaaatagtattttgggtctttgttactttatcttggtcagatgcagacgtttcctaagctatttaaatttcttttctaaaaataagcgttagttgaatactaaaaagtccatttggaaaatatttcaatgacattcagttgagattataaaaaaattagtaaattaagaagatagatttgttaataataaattttattgtttcattatttttgtaacaagtatattgagaaatacaattcacataccatgcaatgtatccatttaaagtatagaaatcattggtttgaatacatttacaaagttatgcgacaatcaccgtgaccaattttagaaatttttcatcaaccaaaaaacaaaccctatgcctttttagccgtcactgtgctatttttttcccaatctctttagccctaagtaatgattagcctactttgtgtctctatagatatgcctattctggacctttagtataaataaaatcctaaaatatgtggtttttgtgattggcttattgcactttgccaatcttgtattcaaggttcttctgtgttgcagtatgtatcagcactttattcctcaataatattcaactctttagttatgcccccgttttatttacctttccattatttaatggacatttgggttgtttctacattttggttattatgaataatgctcctatgaacatctgtgtacatgttactgtatgaaaatatgttttcagttttcttgagtatatagctagaattgaaagtgctggataaaatggtaactaaatgtttaaccttttgaggaagtgcacagtgttttttcaatttttcattcacataagctgtttatgaggattgcaattgatccacatctttgtcaacacttgcaatcattactctttttgattaaagcaaccctagtgggtgtaaagtggtatctcattgtggttttaatttgcatttcacttatggaaaatgttgcttttatagtgtcagtaatcccttctcataatatctgtttttacgtgtctgtcagcatttaaatgcatcaaatagcagtaaatcaattactgtttgctgactgctcttattacttctgggaaacctaataaataaattgccatcaataacagctaacttttaaagcccttgatgagatctagtctttttacatactgcattcaatccgcacatactgtcatagatgaagaaaattatggtgaatgagtttcagtaacttataataggagttgtcaaactactacccagagttgaaatccatctcatggtctatgttcacaatgcctgcatgctaagaatattttttacatattacagtgttactaaaaaaaacaatgtgttaaagagacctgtgtagcctggaaagcttaaaatatttaagctttatttaaagggctacatatggccctttatagaaaatctttgctgacctccaacttacgttgcacatgtggttaaaaaccagcttcatccaattcgggaatgtgagttttgcaactgacaatattgtagtagacatatatgtccttcagtttatctgacctagtaaaacagcaggagaaaacaaagtaaaacaagcacatatatatattttaaaaaagacaaaacatgttgagtattctgtgcataatataaaacctgtggtttgccatgggagattggaagaaatttgagcaattatcccttcaacatacatgagtaaagagaaaattgactatagctggacaaaacctaaataaaatgagtgccatggaaagttggggatttgtgcatgcccttactctttcatagtatctaagggggcttaattgttgtggattggatacactaactcagaaggataacaaagtctcttgattgcacatgatgttggaagacaggctaatttagtttaagaatttatattagaaagtaaaatcaccaatctggaggaataaattatatgagtggaatatgagagttggatgaactatacaatggtaacacacactctgacattgtagaccaaatgctaattctcaatattgacacagtaacattcacaaatctaggtactcaattagctttggtttggcctatttcatgtcacttgtataccatccagagatccaaatgaattatcatggagtcctaaacttctgacattggccatgttttatactctccaccttacctgcccttcctgcctatctccaacatccatcgttaaagaaaccaaaaaccacctacacagttcccttatcaatcactcaataataagcatgggcttgtacatatggtatttttacaatttctctctcctgttattaaatgtcagcatttttctaaataactgccaattaaaactcacattcaaaactataaattttgcattctcagagcgacattatttactttatattgtaaaacaatcttattataaataatttgcatgtgaaactacaatcaccactttttttattattatactttaagttttagggtacatgtacacaatgtgcaggtttgttacatatgtatacatgtgccatgttggtgtgctgcacccattaactcatcatttaccattagttatatcttctaatgttatccctcccccctccccccaccccacaacaggcccacagtgatgttccccttcccgtgtctatgtgttctcattgttcaattcccacctgtgaatgagaacacgtggtgcttgattttttctccttgtgatagtttgctgagaatgatggtttccagcttcatccatgtccctacaaaggacatgaactcatccttttttatggctgcatagtattccatggtgtatatgtgccacattttcttaatccggtctatcattgatggacatttgtgttggttccaagtctttgctattgtaaatagtgctgcaataaacatacgtatgcatgtgtccttatagtagcatgatttataatcctttgggtatatagccagtaatgggatggctgggttaaatggtatttctagttctagatccctgaggaatcgccacactgacgtccacaatggttgaactggtttacagtcccaccaacagtgtaaaagtgttcctatctctccacatcctctccagcacctgttgtttcctgactttgtaatgatcgccattctaactggtgtgagatggtatctcattgtgattttgatttgcatttctctgatggccagtgatgatgagcagtttttcatgtgtcttttgggtgcataaatgtcttcttttgagaagtatctgttcatatcctttgcccacttgttgatgggttgtttgatttttttcctgtaaatttgtttgagttcattgtagattctggatattagccctttgtcagataagtaaattgcaaaaattttctcccattctgtaggttgcctgttcactctgatgggagtttcttttgctgtgcagaagctctttagtttaattagatcccatttgtcaattttggcttttgttgccgttgcttttggtgttttagacatgaagtccttagacatgcctatgtcctgaatggtattgcctaggttttcttctagggattttatagttttaggtctaacagttaaatctttaatccatcttgaattaattttagtataaggtgtaaggaagggatccagtttcagctttctacatatggctagtcagttttcccagcaccatttattaaataaggaatcctttccccatttcttgttcttgtcagattcgtcaaagatcagatagttgtagatatgtggagttatttctgagggctctgttctgttccattcgtctctatctctgttttggtaccagtaccatgctgttttggttactgtagccttgtagtatagtttaaagtcaggtagcgtgatgcctccagctttgttcttttggcttaggattgtcttggccatgcgggctcttttttggatccatatgagctttaaagtagttttttccaattctgtgaagaaagtcattggtagcttgatggggatggcattaaatctataaattaccttgggcagtatggccattttcatgatattgattcttcctgcccatgagcatggattgttctttcatttgtttgtatcctcttttatttccttgagcagtggtttgtagttctccttgaagaggtccttcacatcccttgtaagttggattcctaggtattttattctctttgaagcaattgtgaataagagtttactcatgatttggctctctgtttgtctgttattggtgtataagaatgcttgtgttttttgcacattgattttgtatcctgagactttgctgaagttgcttatcagcttaaggagattttgggctgagatgatggggttttctagatatacaatcatgtcatctgcaaacagggacaatttgacttcctcttttcgtaattgaataccctttatttctttctcctgcctgattgccctggccagaacttccaacactaggttgaataggagtggtgagagagggcatccctgtcttgtgccagttttcaaagggaatgcttccagtttttgcccattcagtatgatattggctgtgggtttatcataaagagctcttattattttgagatacgtcccatcaatacctaatttattgagagtttttagcatgaggggttgttgaattttgtcaaaggccttttctgcatctattgagattaattctgtggtttttgtcattggttctttttatatgctggattacatttattgatttgcatatattgaacctgccttgcatcccaggaatgaagcccacttggtcatggtgcataaggtttttgatgtgctgctggatttggtttgccagtattttattgaggatttttgcatcagtgttcatcagggatattggtctaaaattctctttttttgttgtgcctctaccaggctttcatagcaggatgatgttggccttataaattgagttagggaagattccctctttttctattgattggagtagtttcagaaggaatggtaccagctcctccttgtacctctggtagaattcggctgtgaatcagtgtggtcccggactgtttttggttggcaagctattaattattgcctaaagttcagagcctattattggtctattcagagattcaacttcttcctggtttagtcttgggagtgtgtatgtgttgaggaatttatccattttttccagattttctagtttatttgtgtagaggtgtttatagtattctctgatggtagtttgtatttctgtgggatctgtgatgataacccctttatcattttttattgcgtctatttgattcttctctcttttcttctttattagtcttgctagtggtctatgaattttgttgatcttttcataaaaccagctcctggattcattgatttttttgaagggttttttgtctctatctccttcagttctgctctgatcttagttatttcttgccttctgctagcttttgaaagtgtttgctcttgcttctctagttcttttaattgtgatgttagggtatcaattttagatcttcctgctttctcttgtgggcatttagtgctataaacttccctctacacactgctttgaatgtgtcccagagattctggtatgttgtgtctttgttctcgttggtttcaaagaacatctttatttctgccttcatttcgttatgtacccagtagtcattcaggagcaggttgttcagttttcatgtagttgagcggttttgaatgactttcttaatcctgacttctagtttgattgcactgttgtctgagagacaggttgtcataatttctgttctcttacatttgctgaggagtgctttacttccacctgtgtggtcagttttgcaataggtttggtgtggtgctgaaaagaatgtatattctgttgatttggggtggagagttctgtacatgtctatcaggtccacttggtgcagggctgggttcagttcctggatacccttgttaactttctgtctcgttgagctgtctaatgttgatagtgggctgttaaagtctcccattattattgtgtgggaatttaagtctctttgtaggtctctaaggacttgctttatgaatctgggtgctcctgtattgggtgcgcatatatttaggatagttagctgctcttgttgaattgatccctttaccattatgtaatggccttctttgtctcttttgatctttgttggtttaaagtctgttttatcagacactaggattgcaacccctgcctttttttgttttccatttgcttggtagatcttcctccatccctttattttgagcctatatgtgtctctgcccatgagatgggtttcctgaatacaacacattgatgggtcttgattctttttccagtttgccagtctttgtcttttaattggagcgtttagctcatttacatttaagtttaatattgttatgtgtgaatttgatcctgtcattatgatgttagctggttattttgctcattagttgatgcagtttcttcctagcatcaatgatctttacaatttggcatgtttttgcattggctggtaccagttgttcctttccatgtttagtgcttccttcaggagctcttttagggcaggcctggtggtgacaaaatctctcagcatttgcttgtctgtaaaggattttatttctccttcacttacgaagcttagtttggctggatatgaaattctgggttgaaaattcttttctttaggaatgttgaatattggccctcactctcttctggcttgtagagtttctgccgagagatcagctgttagtctgatgggcttccctttgtgggtaacctgacctttctctctggctgcccttaacattttttccttcatttcaactttggtgcatctgacaattatgtttcttggagttgctcttcttgaggagtatctttgtagcgttctctgtattttctgaatttgaatgttggcctgccttgctagattggggaagttctcctggataatttcctgcagagtgttttctaacttggttccattctccccgtcactttcaggtacaccagtgagtcgtagatttggtcttttcacatagtcccacatttcttggagactttgttttctttttattcttttttctctaaacttctgttcttacttcatttcattcatttgatcttccatccctgataccctctcttccagttcattgaatcggctactgaggcttgtgcattcatcacgtagttcctgtgccatggttttcagctccatcaggtcctttaaggacttttctgcattggttattctagttagccattcatataatcttttttcaaggtttttaacttgtatgccatgggttcgaacttcctcctttagcttggagtattttgattgtctgaagccttcttctctcaactcgtcaaggtcattctccttccagctttgttctgttgctggtgaggagctgcattcctttgtaggagaagaagcgctctgatttttagaattttcacattttctgctctgttttttacatgtgtttagaataacacattttctgctctgttttttactcatctttgtggttttatctacctttggtctctgatgatggtgacgtatagatggggttttgttgtggatgtcctttctgtttgttagttttccttctaacagtcaggccctcagctgcaggtctgttggagtttatcagaggtccaccccagaccctgtttgcctgggtatcagcagcggagtctgcagaacagcggatattggtgaacagcaaatgttgctgcctgatcattcctctggaacttttgtgtcagaggagtacccagccatgtgaggtgtcattctgcccctacttgggggtgcctcccagtaaggctactcaggggtcagggtccaacttgaggtggcagtctgtcctttctcagatctcaagctgcatgctgggagaaccactactctcttccaagctgtcagacagggacatttaactttacagaggtttctactgccttttgtttggctatgccctgcccccagaggtggagtctacagaggcaggcaggcgtccttgagctgcggtgggctccacccagtttgagcttcctggccactttgtttacctactcaagccttgccaatggcgggcacccgtcccccagccttgctgccaccttgcagtttgatctcagactcctgtgctagtaatgagcgaggctccgtgggcgtaggaccctctgagccaggcacaggatataatcttctggcgtgccatttgctaagaccatcggaaaagcgcagtattagagtgggagtgacccgattttccaggtgccatttgtcacccctttccttggctaggaaagggaattctctgaccccttgtgcttcccgagtgaggcgatgcctcgccctgcattggctcaggctcggtgcactgcatccactgtcctgcccccagtccaacactccccagtgagatgcacctggtacctctgctggaaatgcagaaatcaatggtcttctgcgccgctcacactgggagctgtagactggagctgttcctattcggccatctttgctccaccctccactttttttttttttttttttggaaagagtcttgctctgtcagccaggcaggagtgcagtggcatgatctcagctcactgcaacctctgcctcctgagttcaaacgattctccagtcttagcctcctgagtagctgggacaaaaggtgcatgccgccacaccctgctaatatttttgtattttagtagagacggggtttcactgtgttgcccaggctggttttgaactcctgagctcaggcaagctgcccacctcagtctcccaaagtgctaggattataggcgtgagccactgcacctggccagtcaccacctatctttaaaaaaggctttagttagtgctaaactatttgtatttcagctagcaattttatcattagtaacttgattttttatgcttaaaggaaattaaatccattcttttttcatcagaatgaagtagcctcaaacataaacaatttaaaaattcagacagtatctttcatcaggctgaaatatgcctaaaaatcacagtgttccatacagtttatcattgctgattatgttaacacaattataatattttgtatttcagaatggcaatgtaactttttccaaaggacacatgaaacctttttatcaacatccttttgtgcattgctaggtcatataagttcctttctagaatatcccctaatttagttttcctttgaataattgtttaatggataaagtgtatttttttctctagaaatccctttgacctttacagaagactggacttataactgaacattatgccaatagaaatgataagatttgttctaatgcttcagaaatttgcttgaagatagtagtgttagtaaatattcaaaagctgttttcttacacagaaatatttttagcaaaatgaataatgcaatattattaagcattgtttctgagatttttaaaaagtatttttttaacccttgatgcaattgcttgtttttactttaattttatctcaccagctagcaaatatataataacttattttcatcttcttttattaccttaggcattcactataattcctgaatttagatttgggataaaatagtgtataataaaaaaggcaaactagtgttgtttattgaaatcgggacaaaattgtgtatatggttacatcaggtatgttttcaaaaccatgttttaaatcgcctgtttcatctttgcataagaaattgtaaacaaccttcgattatgttgaaacttcaataatactaaaacgttctctttggctgttctttattttccagtctgttattcaaggacatttataattttttgcttcaatacttttccaaattactttctttttttctttacttcctttttagtaaatattatgttctttcataataagtctaactactttgtctgaagatgattaccatgtaatattacttcctcactgatattatgcatttatttatttattaatttaatttttatttttttgagaaggagtctcactctgtcacccaggctagagtgcagtggtacaatctcagctcactgcaacctctgcctcccaggttaagcgattcttccgcctcagcctcccaagtagctgggattagaggcatgcaccaccacgcccagctaatttttgtatgtttagtagagacagagtttcaccatgttgaccaggctggtcttgaactcctgacctcaggtgatctgcccgccttggcctcccaaagtgctgggattacaggcgtgagccgccatgcccagcctatgcatttatttttattgaaatgccttgccacatcttcacccatgaaagttccatattacccccaaagctcacatgttacctgctccatgaatttgatactaattatctgacttacctctttcctaagctgctctaacaaacttaccgtgggcactgttgctattgtatgcactcttgtatttgtcctgagattccagctagactgaaagacttcaagggtaaaagaaaagtatttgaatttgttcagtatctattacctgttacatagtagaacctgaatatgtgtgatttcattttaaatctgttacttatatatggttattataattaatatttgtgcataagaattaaaccataagcagctgaacagaaaaaaaagagaaaatgtcttaattaaggatgatggacaaaagagaaaatagacagtatgctggtggaaacaacgcaggtacagaggctagacacgtttgttcccttcaccaccattttgattaaagaggtgtctgagctaactgaccctgcccaagcatgcacattctcagtagtatctctttttatcaagagcctcgcctcaatccgtgcagcctattctcaacaacatagacagagtgacattgtctaaagttaagtcaaattatctcaaacctgtcttaaaaatctccactggtttcccttttggctcagaatgaaaacaaaattacttattatgaaccatgtatgagtcaagatactttataagcagtaacaagcagcccccagagtcttagtggtttcaaatacaacccaagtttacttctgccttctgctatgttttcattgcggcggttgtgagttctttcctttataggcatccagggataaagactgatagagcaggcaatatctcaagtatgtttgacaccatgctgaggcaagtatatactctggactctggcctacaagaattacatgtcatgttttgctcacaaatctttgtccagagcccttttacataactgcactgaaacatgggggcaggaaatagaaatatacctgaaatggtacttgaaaaggtacccatggggccttatgtgatcacatcagcctctgcccatgttacctctgagatctcatctcctattactctcgcccttacttgatttcaattctgccacaatagcttcattgctgctacatgaacaccccatgcatgttcttactgttgcctaaaatgtcttattttaggtatctccatggttaactccctccctgctctctgatctttactcaaaagagactgtttcaaggggaactccccttgttgttttatctaaaatgaatgtctctgtagatgtgtaaacaaattatcatgactgtatcccaataaaactttatggacactgaaaaatagtgagtgcctccccacctgcatgtttttttttctccttgttcacataatatgttgtcagggtctcccggaaaattaaaatttaatgaagagcgggaattttcatttgctttgtgctgctatattttcagcatatagaacagtgcctcaccatgataagtgtttaataaatatttgtttgcatacatcttaagtaaaaattattaacaagcctcttaacttattgcaattatgaccacaatagcatacttgtaattacagtttataattatttggctaccatatgaatgtctattacatgcaagcattttactaggtactttctcatgggctgactcattttgtttcatgatagccctgtaaagtagatacagtcatcccattttacaaatgaataagctctaagaattagtttgcttaagaacccacaggaataaaactaagttacctgaacatggtaaagttttcatttaatgtttggttttagctaaataattctccctatagacctttaagtgtaagaacaatattatttgttctaatgataaaaggaggtaggagaaatttggttacctgcaatgattttcaagtcatgaaagtataccaaataaacatttcacattcacatttctgcaacttttccaaggataataccagtcctgaatcttaactagatattagaattatttggaagctttaaaaaatgctgatgactagttctcacccacagaaatactgatttaatgtaccccaggtaattctaatatgcaactaccattgcgaaccacagaattcgacgattagcttaatcactgagtttccagtggtagtggtggtggagatttgttgatactgtttgtcagaaatgaggagtgtctactaatttgtttaaactgagttggataccatttcccattaatttcattgatagaggaaaataatgaggtaagcattaatttcttaaaatctggcacacattttcacacatacatctttctcatcagtcttctgtgtttttttttttcaaggggaaaaatacgttttctgattttggtaaaaataaattgaaaaagttattggagaatagagaaaaattatgtcaactactatccaatttcctttttgagttgtcaaattgttgtggttggcagaggctcagaacctacaaaaagtcactgttttatctgggattatttacattttccttcaagtatccagtcctggttttgtacactaaggaagtcaactccattctggggaattgctctgaatgtgtttttgttcttgcattgacagaattcttggtttatcagtacagatggcatgcttcaatagtgtagtcatgcagatcttactacatagacttcatttctctttaggatggccaatatcatgaaaggatggtaattctccaatttttccatgaaataaccataatgggtgttaatattagtatttgtttttacctgtaacaatctctatttttttagccataatttcaattatgttataataaaaagaattaaagtgctaatatgagcatctaattctgttttcctcctggtgacatctccacaaagttgagttgctttaactttattcttatctttattcagacactgaaatattctcaatcctggtggtgaaaaatggcccattattttagtccagctcatgaattaattcaatagctaggcatagtaacctggaaggtgttggcttctatttcagataaattattgtgagaaaaaaatacaaaagatttgttacaaatcgtgtgaatgatacagcacctttatggcatacagtttgtacagttaaaaaacagcaagtctctacctcagctaatgcaatgtatatgctactcagtgtttctagggttgcaaaatgcctgtagagctgtccccgaagagatttactattaggattcagttctagaataaatgaggaaggggtaattctcatttcctattatttatgaactatccttgacttatcattcaagctctctaactcagtcagcgtgcctcaaattcctcacactttgtgcttcaaatgcatacctcgaaacattgttcgtcacacgcaacatgctctatcacaacaaatcacaactttttgaagagcttttgaaattttaactctgttgtctttctgggattatcctttcttcctcttaatgctatgctaaaaacatacacaacgtagcctaatttaatggtacctatgattttgattcacatttatctggaaaattttctcttctttcttaggcagtgggacttcttttgaatcaaagagcttttcaaaccatgtaagggcacatggttgtacaagggctaaccagaattctcactgtacataaaaagaggccttctggttttgaaatcttttataggtttcttcaattacctgtcattaacacaacatgtgagttttacttccagtgcagctttgcttatttccttgtcggaggatcttgtattagatttcttgctatattctttatcatgtgctccaacatgctctatactaaattatcccttaaaaggttgacacagaaagtcctagaatctgtttgattctgcaaggcctttgaaagatggacccacaaccagatgagttttatttgaactgcatgtctcatttacacactccagttctacgttaatattttcaagactcagcttggaagaaaagagagtactgaagtagcatcttactataccatttatgtagattttattgtacccagatttcttcaaatagcctaaaaagtactgtgtttggaattagagaacaatttaattcctcactctcttacatgtttgtattagggttctctagagggacacaactaatagaatatatataagatggggagtttattaagtattaacatatacaatcacaaggtcccacagtaggctgactacaagctgaggagcaaggagagctggtccaagtttcaaaactgaagaacttggagtccaatattcgagggctggaagcatccagcacaggagaaagatgtaggctgggagactaggccagtctcgccttttcacatttttctgcctgctttaagttcgctggaagatgattagagggtgcccaccagattaagggtggttctgtcttccccaacccactgactcaaatattaatccctttggcaacaccctcacagatacaccggagattaatactttgtattcttcagtccaatcaagttgacactcagtattaaccatcacaatattaaatgggccatgttgagaaactctaaaaatcttgaacttcaaatttctttattgctacttttctttcaagcctatttgagttaaatggatttgtgtattggctgaggatctaaaagcaccatacaaatgtgctagacattcttttgctgctcaagattcaaaatctctctttctccaacctgctctgtgctccaggaactgagcctatgcttaaagaagacttccctgtcctctagctctcagttggacagggagaagcgctaacggaaagcgggaaggaggaaggatggagaactcaaggcatgttttctactggcttcctctttgctaggtcgcagtttgccattgacggtctctgctattaatatttttctctaccaatatctacaactgtttttgggtgttcactctcccatacctacagttccagatggttcctggtaactgctccttcctagctccttcaggtccaagccttggcctcccaaagctctgagattacaggtgtgatccaccatgcccagcctgcaccaacattattttgatacacagttttaataattatttttgagatatatacatatatgtatttatgtgttctaaagaaaaccatacatttaggaatgggatagtgtgtctgcatgtatgtgtgtatgtagaaaatttagaaaaatataaatctccatatatcaatataaattttctcattaatacattaattatctacatctatatagatatatcaaaaataattcttaaaactgtacatcaaaatactattgatgcaggctgggcatggtggatcatacctgcaatttcagagcttttggaggccaaggcaggaggattgcttgaagccaggagtttgagactggcctggacagcatagcaagactccacctcaacaaacaaataaattagccaggtatggtggctcacacttgtagtcctagctacttggggacttaagtgggaggattgcttgagcccaggaggccaaggttgcagtgagcaatgagctatgatcataccactacactccagcctggttgacaaagatagaccctgtatgcagccatgaaaaaggatgagttaatgtcctttgcagggacatggatgaagctggaaaccatcattctctgcaaactaacacaggagcagaaaaccaaacactgcatgttatcacttataagtgggagttgaacaatgagaacacatgggcacagggaggggagcatcacacactagggcctgtcaggggtggggagctaggggagggatagcattaggagaaatacctaatgtagatgacgggttgatgggtgcagcaaaccactatggaacgtatatacctatgtaacaaacctgcacactctccacatgtatcccagaatttaaagtattaaaaaaaaaactgttgatgcagatacttacgtattaatcgataaggttgaagctactataatagtacttaaaattaatactctaaaccagtagaaaaaaatgtgtgtttacacacacacacacacacacacacacacacactttatctcaaatagaaatcactcataactccatggctagagtagctttattcctaatccaaaaagctttttgacagagtgatactttattgttatcaagttatttttgcactcaaatgtgagaaaatctggggtgtggcaatttctagattattctcctagaaaaccttggctataagagtttgaggatattcatctttgaggttcatatgcattctcctctctcatggatgtaccatgcctacatcccacactcagctcaccagctgaaaatccacctttactctttcagatgcttatgtattattattcaaataactttccatctgctctaaacacttttaataataaggcaatttgcaaacaaacaacgttatttgtaaccagtgactagtggcattcattccagaaacaatgttacccagctgaatactactgctctcaaagctcagcccatagtccttcaagcacagcacaagtgggagtctctgttttaggaacattcttcacagctccctagtgttccaggagtaagttaactctccattcattattcacatgtctacctctttagttccattctgagacaggataaaaactggcttcttgttgaatgcaatttacctcaacccaaagttgccattctgttccttgtggtttgaggtttggtttttttgtttgtttgttttgtttctattttatttttttatttttaagaaaacattaaacaatggcagttgttctaatcattgctctttctgggctttgactcggctataaagggaacttggtattaggatatgtatataatttctgccagatatttttcatctatttatatttcattgtaaaatttatcacagttttctgcgctatttacaacattgtatgtacttatattgagatgaaaccagtcttccctgagaagactcacttttgcttttgaacctatcatctcagttaccgtcaaacactaaagtgatggtttgaatttgtgataatgtgtctcctatctcttggtgtggaatatattcttactaggattacctgaattaaattgctaaccttaagaatgaagggaagatgcttattatttcagctcttgatagattttaactttatgagatttataattagtgtgagtaagatcaatgatatttgaagttcattgaattttcagctaggtgatactcactattttcttttggagcacccactcaatataagcctttgttggtctgacaaaaattgcattcagtgtgatattttggtaagtactctagcataagaaaaagtgcttggattcccctaaacttatgtttgcatatagattctcatacttattagttacattaggttggccaaatttaatactgtattgtattgatttaaaatttgtatcgaacatgagaggctaaaaatacctgccatagctggttgtgaatagctaatcaacaaatatattgtaaattttcccacttatactcttttttttttcttttttcttttcttttcttttctttttcttttttttgagatggagttttgctcttgttgcccaggctggagtgcagtggcacgatctcggctcactgcaacctccgcctccccggttcaagcgattctcctgcctcagcctgtgagtagctggcattacaggcatgggctgccacacccggctaactttttgtatttttagtagagatggggtttcaccttgttagccgggatggtctcgatcgcctgaccttgtgatccgcccgcctcggcctcccaaagtgctgggattacaggcatgatccacggcgctcagcctctagtcttctttttcacttttcttatattgcagattaggaaaactaactactaggaggtatgcagggaaaaggcagacttttactaatgttttttaaattgtgataaaatacacataacatatagcttaccattttaagcatttttcagtgtacagttcagtagagtcaaattcatccacgttgttttccaccaaacaccagaatgcttttcatccagcaaactataattctatacccataaaatagcaactcactaggcaccctttctcccacagacttgttgttttataaatatttttatgatcacagcaaacttagtaaaaattaaagatttattccaaatcattgtgcttcattaacatgagttataatcacatttactatacaactcattttccaaaaaaaattctattttaaaagataaatctactcttttcaagtaaagttcatttgttaaaagaatatggaaattattttactggtttcctcaaacttgcttttagaaaacagttactacatctataaatagatagaatgtgtgggttaggatctttgctacggataagtcatgtttgataacaaacttgtggggcctgaatttttttttttttttttttttttgagactgagtctcactttgtcaccaggctggtgtgcagtggcgtgatcttggctcgcttcaacctcagcctcccggtttcaagtgatgttcctgcctcagcctcccaagtagctgggattacaagcacatgccaccactcccagctaatttttgtatttttagtagagacggggtttcaccatgttggccaggatggtctccatctcctgacgttgtcatctgtcggcctcggcctcccaaagtgctggtattacaggtgtgagccaccacgcccagccctgaaatgtttaactgttggccagctctctcctgactctaatcttggcttaaaatgtgaatatttttatagatattttaaactttgctcaaagtaggttaatactaatttctagagttgtatgtatatatacatataacacacaacttacatatatatatgcatacacagagatagaggtttattttcctatttttgaatttttagtttccatttatatgggttatagtctggggaaataaataaataattgactcaggaacatggaaacaattattcttaagtatcatttaggtatttttttaactcagaaacatttgtgtttgatttcaataagaaagaacatactctgctatataatagcctttagttgtaaagattaagcaaattaataaatgtaaagcacttaaagcaacacatatagaaacatagaaattactcaaagattgttagctattataattattgctgctgttactgtcatcattattacttgagggattaaatggaatgaacagcgagccttatttttaccagagttacagttggcaaacctcagagatacactctacccaagatacctgcccttgaaaatatgcgtccaaagtgtatcttataggtggtaaatactatgaatgaattaggttctttaattctgcaaatgcaaggtaccttccaatctaaaatatatgttagacataatctaaatctttgtgccttctttaaaaaagcagcaactaatatatagctttttaattggaaatatcttttaaaaatgtgtatgcctcctaaattacatttgcagctaaaagattaaacctctgctttgctctctgtggatgttattgtctatattcataactcaaacagaagtaacttgctaatttttgtatttttagcaaagaaaggaggaagcattgtgttccttcttattactgcaaaagtgcatttgagtgtgagaggaaagatgcagagggtatttcaaaatgctctcattattatgagttgagcttttatttctttcagggtactttttagaattcattttacaatagatgcaaacttttcccacataataatactttatttaattccaattgaatcccaccttcacattcaatttcattgaatttcagtctttaaaaatcttccccattcccctacttgcaatattgtgatctctacatttggagagatacttcaggataacagctatcattggccaagcctgtatggctataaagcctagtagctcttctaattttcttccacatttggtaatctttgtacagccttggaagcaaagttaaactattacatttctattctaacagagtccagacttctggaactgaaaaaccaggaatgcaatttgtccgtaggctacttctctttgattcagtacataatgagcccctttctaaattagtggcccataatctttagtgtgtatcagaatcacctgagagctgtataaagcacacattgctgggctcaaccactagagtttctgattctgtaagtgtagggtattcgcagggatggagaatttacatttctaacaagtggtcaggtgtagctaatgcaactggtctgatgtccttactttgagaaactctactttgagaactctttacagggtgtgtggtgaggtaaatgttctatgaaaaggaaaaaaagaaggtgcatatctcaatacattaccttgcccaattttttgcaggtatatagggagtgcatgtacagaatatacagccagacaatgagtgattaaaagcttggcattgacatacacttggaaaacttacagaatctgttttctcatcactttaactaacagaagcttcttgcaagagtggttgtgaatattcaatagtactttcaaaaatgccaattactgtcttacttttacagatctttccaaaatatcagtgtggaaaatggaaacagcacagtctttggagtaagacatgtctgagttgaaactttggtttcctaccacatcccaaatctatgcacaacaggtgaattggcatgtatccatgatcccagtgtgatacatgtataaaaacattaaaaataaaacaaatggagtgacctgcaggttatttacatattctaagttgacagagatttaaataaattacattattaaatcagaaatcagaagatttgtaagttcctattgggataaaaggggactaacatcaggacagggaacccaggggctttgaagatatggatagaattctatttctgaagatgtttggtaggtttatgggtggtatgttttgttattctttaaaatgtgcaaatacattattgtgttcttaatatttttggagtatatcatttgtacagtacaaatgaatgcactggaatatataaatatgccagtgagttttactgcaggaaataaattaattttaaattatgttacaaacatcaaaataatactttaaaaattttttggactagaataagaatgatactgagatgatcacctctgggcttcctccctcacctttgaacatcctattcatccgatgagttatacgcagcacccctcttcttgtggaaactggaataatccatttatttcctttgaatagctcttcatcattttcattgatttcctttctgtgagtaaaatattctttgatttcttatgtcattttacttttctcttcaggctatccatctcttctcatgccttgtaacctctgggagctcccgttctctgattacttctctgacttagggtagatttccttcgaaactgctgaggcatttttttcctccatcaccccaactatgtgtgtgtattctactgtatcgatatctgccataatttgatgtacttgaaattccctttctttcttgttcccgtctgtcatggcaagcaacatacacaaaggatctctgcaataagcaattttcttgctggactgctgtgggcagtgactgggacttttatagtaagtatttatgctgttagtgccaggaagatttgagacagcattatcctgagaacaccaagccctgtattgcacttctatttcaggggcaattattggacagtgcatggaaatgttacagaaaaaaaacccacactattttctaacaggcaagttaaacaatgccaatgattgctgataattcacataaatactacacattacaactttacgatgcagcaaatactgtgctatgctgatttttcattttaacaatgtaaaaactttgatctgacagtaataggcaaaaggcccaattgaagaaaagaaattaggaggagaagagaggattggaccagagaaaaattatgaaagaaataattccctttgggtactgatgtgttacttgtagtttatgaaacttaatcgggagataaaattctggataagaacataataaaaaacttttaatttcttgttctctgtcagcataatccacttttatgtgcctcggctttttcatatgctccatcaaggctaagagatatcacgtaaaaactttggggaatgaacttctaaattggccccttatatcaagaagcctaaaatcaaatgctgtcattcactttttaaaacaaaatttgtcatgtgcttttttaaataaaataactttaatcttaatttttactaaggaaacaggaaatgcataaactgtaaaaaacatgtaaatctcctgaaatcatactacaaatgatatgcataaaatgatttgttttatgtattacattgggtacataatttatccaaacatatataatcagtcacttaagatgtttatgctatttaaatattgtatatgcacacacatcatgtagctgtgcaatacttgctgcataattaactatatagatataacaaacttccttttcctatagagttataatcggttattattatgaacaatgctgaaaaacttatgcatatatctgcactattattcataattttctatacatattcctaaaagaagaatggctggaatcagtggatatatatctattatatatccaatatatttagatatattttttctaaatgcctcacctaaaatattcttaccagttaaaattacactgaacagtttctgaatggctgtgttttctcatccttaacaatactagaacttattcttgtaacctcgcgaatagagtaaatacaaatggtagccactttgtattttagtgaaattattcaaataatacccaaaattaacatctatcttaggttgggttccttgcgaaacagaccctgaaatgcagatttgagagtaggaatttaattgggaagtgcctgcagcaataactgtaggagattgggttggtctgggtagagactgtagaaactcaatgcggttgacaaatgcagttataagatagttctgcagagtacttaggagctagcgtggtctttctgagttttcttgaattaaggcatgcagatactcaaagtgtttgtatattcccctttactcagttcatatttaaccaaggaaatggccacaggttcttttggaaaagaaatggggagtcattatcaacaacacctgctgaattgcagggttgctcctgtgagattattttttccttcagtcaatgagttctggctccattatggaaacttggaaaggactgtatttcttttgggattactactgtattcttctgattgtctgtccttgatttcttttaactgtacagattgagcagcaccctattgcctgcccatcaatcttgcccctaagaacactaccttctcttaacatctccataggtgtttgcgggttaggctttgctgaatatcattcaaaacttgctgctcattacatttgggtccactttgcttatcagagctaagcaacaccactttgcctctgtattttctcaattctatcatttccatccctatcagtgagccagaattttcatattcaagtttttttctcatgtatgaatgttgctaacctaagattaagtcctttaacctttctatgctataggcttctctttggtaaaataaaagtaaaatgttttatttcaatctcataatcttgattccaggacaaaatgaatgaattaaaatgtgtgatgtatttcataatattgcagttttaaacaaatatagcattgtctttttattcctttttataaaaccattcaatcttcacattatactgctaatacctcaaaatatcctgtcttaaaatgttggaaaaatcacattttcctttaccataactccctgtttgcaagaattcaccgttacaaatttgcatccagaacaaaaatgattttccttctagccgttatagaatataatacttaaaacactgtagatcaagatacttaaaatatgacatggaatcaaggaacaagacaggaccccagaatttcagtgta

SEQ ID NO: 458 - DNA, 17574 bp, Homo sapiens
aaattaaaaatttataaatacacatttataacactgatacaatggtagacttaaaagtcattcaaaaccttttttaaaacttgaaaaattatttcctgaacatggataaatgaaactacatcaaaattaaaaacttctgtgtctcaaagatacaatcaaaagagttaaaaaggcaatcttaaaaatggaagaaaatatttgcaaataatacatctaataaggggtaatggccagaatctataaggaacttctacaatcaacaacaaaaagcatttaacttaatttaaaaagggaaaagatttgaatagacatttatttaaagaagacatacaaatgaccaactagtatatttctatggtctgaatgttcctcctaaattcttatgctgaaatcctaacactgaagtgatggtattagaaggtaggcattttggcagcagattaaaccatgagggcagatccctcattaatgggattagcacccttataaaagagaccccagagagccaactttccttccagcatgtgaggatacctcaagaagacaccatcatttgagccaagaaatgggccctcagtggattcagaatctgcaggggccttgatgttggactttccagcttccagaactgtaagaaataaatttctcttatttgtgaattaccaagttgatggtacttgttatagcagctctaacagactaaggcacatatggaaagatgctcaacctcactaactgttaggggatacaaatcaaaatcacaatgagatatcacttcacatccatcagggtggttagtactttaaaaaacaccccaaataacaagagttggcatgatgtagagaaatggaaagacttgtgccctgtttgtgggaatataaaatgatgtagcatagttgtaatggaaaacagtgtgatgttccttaaaaacttaaaaatagaattactatataatccaaaatttccacttctgggtatatatcccaaacaatttttcaaagcagggtttgaagaaatatttatataccatgtttataaaagctttctttactgtagccaaaaggtagaagtaatccaagtgctcatcaatggatggatgaatagataaataaaatgtagtgtatacatataatggaatattattaagccttatatgcattccattaaacacatcatggaatattattcagctttttacaatggagtattatttttcataatattattcagtaaaatgtggtatatacatataatgaaatgttattcaatcttattctgacacatgctgcaacatggatgaaccttgagtacattatgctaagtgaaataagccagtcacaaaatagcaaatactgtatgattgcacctatatgaagtatctagagtagtcaaattcataaaaacagatagtagaatagtggttgccagaggcttagggatggcaggagctggaaggagtggagagatgttatttaaggagcatagaatttcagttttgcaagatggaaaagtctggagattagttccataatgctgtgaatgcagttaatactactgaactgtataccaaaaaatggttaaggtggtaaattttctgctaactgtactttatcttaattttaaaaataggtaacaagggcaacattattccttggaaaacaatgctaaaatataacttagctaaattcagcccagccaagcagtgattaaaggatgaggtagaggggaatcaacattggagaagggatgtagaccaaaagcagcagatgggcatgggctcgaggaaaagtcatcattcctggtctaggggttggctttcagatttgattattctaggcttcagagttaagaaggacataaccaagtcacaagagtttatatacagaaaggtaaatttttgaaagtacagtattctctgtggataataggtaagtgttaattgcactaagttctttcctagtggattaatatatccagaagatcaataatttccttgttgtgactgtcacaaaaagcaaggaaatacatgatttcaaacaatgcttctcccacattgtttaacttaacagaattaaataacgagaatagtgttaatacgaagaatgaaatagctaaattctagaaaatgtttattgtcagtcacacattgttaacacttacaaattaatcctcatttcacctcatgaggaatacctgcatttttcatatttattgaatgtgtaccagtggccaattccatttagtccctatagatatcagtgtctctgatggttaattttaggtgtaaacttgattgcattaggaatacctagcaattttggtcaagcattattttggggtgtatcccagggtgtttccagaggagattagcatatgtgtcttaatgggctaagtggggaagatccaccttcagtgtgggtgggcaccatgtgatctgctgggaatctagagagaacgaaactgataaaagacagatgcgtggatctatccactgaaaccatgatgcactctttctcccctgtccttcaacaacaagtccaagctccccgatctttggactccagggcttaaaccagaagcccttcggttctcaggactttggcctgggactgagaatttcattatccacttcccttattctgaggccttcagacttgaactgagccacactaccagcatcctagggtctccatatttattatatgtaattattatatatatttattacatctatatacatatatatactgattttgtcttgctggagaaccgtgagtagcacagtgaccaaagcggacagtggtaagttatattattattcctatttacagaagaaaatacagaagtatagggagttattgaattgtggagccactgttggaatgcagaaaatctgactctgaatcctcagctcttacatgctcttgggacatgttttggtcaaaagaaccagaggtgatttctagactgatcaatgcttttccagtagagtcctgcctaaggaataaaaaagtcattctcttcagctgttatgcttcttcactgtaaagtcccatttgcttatgccagatgtgtttcataatgaatatattgagccctattttacttacacatgttctatcctagttttgtctccttgagaatttatctttataaattcaaatacatttgaaaaataatttgttcatcccagtaatatacacaacataatcatggtacaattattcaaacaaataaattaacattgatattatattaccatctaaactttagatttcatccgtttttttcattaacattatttttctgtttcaagaatcaatccaggatcccacactgcatttatttgttttatttctttagtctcctccaatctataacacatgctcagtctttcctagtctttcattatcttgaggcttttaaataaaattgatcagctgttttgtagaatgtccatcaatttggatatgtgtggtattttctcatgataacattgaatttacagatttaagagaagcataccccatcattgccaagatcttggcctgcctgcctatgtgtacaaacatgtatgacctacccaggcacagagacaaaagaagctctttcccctggtcccagagtgcacattcagttcatttgtgcatatacccatgtctaggtgtcttgatggctattgagggagttggtgtggtaccctagtgctattagtgcaggacacagcttgcttaacatggaatcacagcaacccttttaaaaggcataggtggaatttccattcacataaggtttgtgtttgcatgtgtttttgactttttaaagacttaattgtcacaagtttcatgattaactgtcacaggctgctatataacaaaactttagctactcacattcatgcctaatagttctaatatattatttatctaggtttgatatccttgtttcatggaccctgttagagcaaactaaatacagcttgagaaggactccatacttctatatttaagtccttgtggatgaactgcaacctaatttaataggtagacaagattgaaaacctaacttaagaatatgagtctgtatcaatagctgagtcttgaccaatcccagcagccatacctcaaccagtcatacactgctgagtgttcaaactgtgttcaaataaggcaaatgccaagctgtaaccaatctagctgtttttgtagctcacttctgatttctgtacgtcattttactttttttgtctataaatttgttctgactacaaggcaaccctggtgtctttctgaatctgctgtgattctgggggctacccaattcatgaatcgttcgttgctcaattaaactcctttcaatttaatttggctgaagtttttcttttaacaaccttaatcctcaggaagggtttctaattctaaatgtaactacttagtgcaaagtgcaccaactggaaagaaaataaagataattaaagtgtcattgtcttctcaactaagttaaatgaatgaattttgcaaaggtctttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaacctatgctgaagacactgatgttggccacatctccatgaggaaactctgtgctcttagcaaccactttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtgggcagggtgctttccactaaccatggttgtgctgaattggacttccttgggttgtaacccttgtagctcatgaatcacctggcaggaaggagaagcaaagccatgctcaccccttgccctgaggcttcagaaacttggctgtctccagctggtgctgcatagtgattgatccttagccaagtcttcctgtgcaccagggggctctccatgccctttttaggtttactagatgcactttacctggggtgggggtggaggaagtaaagtgaagttcgcagcaggacctgggggcaagggtcagccacctcagtgctcatgcactccattgcactccctgcccaggttcctccagatttgccactcagttccccaatactgtagcatatataacatgtaaattataaacataaaattataaggcccccaaaccacctgaatgaacttcctcctctgacagggtattcttaaaatttaacctgaaagactggttcaggcatgacagttggacatgcttcattggaactctccctggcattaacatcaacacagaacttaagtctcataagaagcttttacaatctattctctctgaagcctgctacctggaagcttcatctgcataaaattttggtctctacaacttattgcaacccaggctttcctttctattaataataactctttcaaccaattaccagtcagaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccaagtgtcacaggcaatggtcactcatatttggctcagaataaatctcttcaaatattttatgaaatttgactcttttcattgacaatagctccaggatataaaaaatatatggctgtagcttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactctaacccatcaataggagaaaaggaatttaaaattgggtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcatgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttccccacatagccatccattgccaaaaaaagttaaaatgtgcctgaggctgggagtattttctctaagatacaaacattaagaaaaagtgcttattcccatactggggtcagttcctgacaggaaagagcctctttttaactctgaaatgaaatctcctgccagggacacacttctgcataagcagaaaagctgctcctcacagacttggccgctgtcttggtgcattttggtcatcggtggctctcttttcctgtaaatgttttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgctggagattttataggataaaatctatgctgtctgttgaagagggctttgtgtggtattgataacacaaaggttgcagtgagctaacttgcagatgtctactgatagctgggtacagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcattataaaagggacattccctctttttccagaaatattcctaagaaaagaaaaacagcctgttatataagagtgtctgaaaaaactagaactttcactcaaggtcggctttaatttgcagttttgtattcataaggggaaagtgatgggcaaaccccacaagagaacagaaatcagctgtgtgaataggcactgcaggctaatgaagagtgaagaggagagcacagtgggaatttctagaggaagagaaaggaatctaatgtgatatgggagtgaaaaatgggatccagaaaagcagagaggaaatggggaagtggaccaggtctcagaaccagcaaaggctactatgtatatttcacttagtttaggagactaacttcatatgggagcgtatgctggaattctgagagccagaaaaggaacgtgccaggtgccagaatcagttaataggcattatgtgtcttctgcatttcaatctacatgctgcttcttttctttcaggtattcatacaaaccaacatttcctgactgaatgcaaataggacacttctttgaaatgaggagcgacaaatttttaacctttctagaattcatgacagaatactgttttttttttttttttaacgctgtctccattgaaagtcagttactgaatggtaggacacaattcttatgaattttgtagaaagacaaataatattctcatctacaactgtgtgaagaaaaatagaaaaatacttgccatgtgttaaatccttacactatggagaatactatgcaaactgctttcaactgcctgcgttcatttaagaatcacaacaactatgtaagtatttctaatcctttctatttataagaaactgaggctcagagatattaagtgctttttttcaacatcacacatacatgcaaacagagtgaaatttcaatgttaaattttttattgttatttacaactaatgtgtaagctttgtattgggaatttctgcaataattttaactctcttttgattcctggattatacacaactctctcctgctctctgtatatccttggttcatgttgtattttcggctgattttgaccaatcttttattttattttgtatttttatttattatttacttattttttgaggcagagtctcactctgtcacccaggctggagtgcagtgacgctatctgggctcactgcaagctccgcttccagggttcacgccattctcctgcctcagcctcccaagtagctgggactacagaaacccgccactacgcccggctaatttttttgtatttttagtagagaaggggtttcactgcgttagccaggatggtctcgatctcctgacctcatgatccgcccacctcggcctcccaaaatgctgggattgcaggcgtgagccaccgcgcctgggccctatgttttgttttgttttgttttttattattatactttaagttctgggatacatgtgcagaatgtgcaggtttgttacataggtatacatgggccatggtgatttgctgcacccatcaactcgtcgtctccattaggtatttctcctaatgctatccttcccctagcccccacccccaacaggctccagtgtgtgatgtttcccttcctgcgtccacgtgttctcattgttcaactcctatttatgagtgacaacatgtggtgtttggttttctgttcctgtgttaatttgctgagaatgatggtttccagcttcatccatgtccctgtaaaagacatgaactcatcctttttatggctgcatagtattccatggtgtataggtgccacattttctttatgcagtctatcattgatgggcgtttgggttggttccaagcctttgctattgtgaacagtgttgcaataaacgtatgtgtgcatgtgtctttatagtagaatgatttataatcctttgggtatatacccagtaacgggattgctgggtcaaatggtatttctggttctaggtccttgaggaatccccacactgtcttccacaatgtttgacctaatttacactcccaccaacagtgtaaaagtgttcctatttctccacaccctctccagcatctgttgtttcctgacttttttaatgattgccattctaactggcgtgagattgtatctcactgtggttttgatatgcatttctctactgaccagtgctgatgagcttttttttcatgtgtctgttggctgcataaatgtcttcttttgcgaagtgtgtgttcatatccttcaccccctttttggtgttttttttttttttttttttttttttttgtaaatttgtttaagttccttgtagattctggatattagctctttgtcagatgaatggattgcaacagttttctcccattctgcaggttgcctgttcactctgatgatagtttcttttgctgtgcagaagctctttagtttaattagatcccatttgtcagttttggcctctgttgccattgcttttgatgttttagtcttgaagtctttgtccatgcctatgtcctgaatggtatcgcctaggttttcttctagggtttttttggttttaggtcttacatttaagtctttaatcgatcttgagttaatttttgtacaaggtgtaaagaaggggtccagtttcagttttctgcatatggctagcaagttttcccaacacaatgtattaaatagggaatcctttccccatttattgtttttgtcaggtttgtcaaagatcagatggttgtagatgtgtggtattatttctgaggcctctgttctgttccatggttctatttatctgttttggtaccagtaccatgctgttttggttactgtagccttgaagtatagtttgaagttaggtagtgtggtgcctccagatttgttctttttgcttaggattgtcttgactatatgggctcttttttggttccataagaaatttaaagtagttttttctaattatgtgaacaaagtgaaaggtagcttgatggggatagcatctataaattaccttgggcagtatggccattttcacactattgattcttcctatccatgagcatggaatgtttttccacttgtttgtttcctgtcttattttgttgagcagtggtttgtagttcttgacgaggtcctttccacttgtttgtttcctctcctatttccttgagcagtggtttgtagttctccttgaagaggtccttcacatccattgtaagttgtattcctaggcactttattctctttgtagcaattgtgaatgagagttcagtcatgatttggctctctattattggtgtataggagtgcttgtaatttttgcacattgattttgtatcctgcgactttgctgaagttgcttatcagcttaaggagattttggactgagacaatagggttttctaaatatatactcgtgtcttctgcaaatagagaccatttgacttcctctcttcctatttgaacactctttatttctttctcttgcctgattgccctggacagaacttccaatactatgttgaataggagtgatgagagagagcattcttgtcttgtgccagttttcaaaaggaatgcttccagcttttgcccattccatatgatattgactgtgggtttgtcatgaatagctctcattattttgagatgcattccaccaatacctagtttattgagagtttttagcatgaaggggtgttgaattttatcaaggccttttctgcatctattgagataatcatgtggtttttgtcgttggttctgtttatgtgatggattacgtttattgatttgcatatgttgaaccagccttgcatcccaggaatgaagccgacttggtcttggtggataagctctttgatgtgttgctggatttggtttcccagtattttattgaggatttttgcattgatgttcatcagagatattgacttgacatttctttttttttgatgtgtctctgccagtttttggtattaggatgatgctgacctcataaaatgagttagggaggagcccttctttttctattgtttggcatagtttcagaaggaatggtaccagctcctctttgtacctctggtacaatttggctgtgaatccgtcttgtcctggactttttttgttggtaatctattaattactgcctcaatttcagaagttgttattggtctactcagggattcgacttcttttttttttcaattttttttttattatactttaagttctagggtacatgtgcacaatgtgcaggtttgttacatatgtatacatgtgctatgttggtgtgctgcacccattaactcgccatttacattaagtatatctcctaatgctatccctccccactcccccaaccccacaacaggccccagtatgtgatgttccccttcctgtgtccaagtgttctcgttgttcaattcccacctatgagtgagaacatgcagagtttggttttctgtcctagcgatagtttgctgagaatgatggtttacagcgtcatccatgtccctacaaatgacatgaactcctccttttttatgactgcatagtattccatggtgtatatatgccacattttcttaatccagtctatcattgatggacatttgggttggctctaagtctttgctattgtgaatagtgccacaataaacataagtgtgcatgtgtctttgtaacagcatgatttataatcctttgggtatatacccagtaatgggatggctggttcaaatggtatttctagctctgatcgccatgctgccctccgcaatggttgaactagtttacagccccaccaacagtataaaagtattcctatttctccaaatcctcaccagcacctgttgcttcctgactttttaatgatcgccattctaactggtgtgagatggtatctcattttggttttgatttgcatttctctgatggccagtgatgatgagcattttgtcatgtgtttgttggctgcataaatgtctttttttgagaagcgtctgttcctatcctttgcccactttttgatggggttgtttgatttttttcttgtaaatttgcttaagttctttgtagattcttgatattagccctttgtcagatgggtagattgcaaaaattttctcccattctgtaggttgcctgttcaatctgatggtagtttcttttgctgtgcagaagctctttagtttaattagatcccatttgtcaattttgacttttgttgccattgcttttggtgttgtagtcatgaagtccttgcccatgcctatgtcctgtatggtattgcctaggttttcttctggggtttttatggttttaggtctaacatttaagtctttaattcatcttgaattaatttttgttctgccctctcttaccactcctattcaacataatgttggaagttctggccagggaaatcaggcaggagaaagaaataaagggtattcaattaggaaaagaggaagtcaaatcgtctctgtttgcagaagacatgattgcatatttagaaaacccaaacacttcagcccaaaatctccttaagctgataagcaacttaagcagtctcaggatacaaaatcaatgtgcaaaaatcacaagcattcctgtacaccagtaacagacagagagccaaatcatgagtgaactcccattcacaattgcttcaaagagaataaaatacctaggaatccaacttacaagggatgtgaagcacctcttcaaggagaactgcaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctactgatgactttcttcacataattggaaaaaactactttaaagttcatatggaaccagaaaagagcccgcattgccaagccaatcctaagtcaaaagaacaaagctggaggcatcacgctacctgacttcaaactatacttcaaggctacagtaaccaaaacagcatggtactggtaccaaaatagagatatagaccaatggaacagaacagagccctcagaaataataccacacatctacaaccatctgatctttgacaaacctgacgaaaacaagaaatggagaaaggattccctgtttaataaatggtgctaggaaaactggctagccatatgtagaaagctgaaatgggattcaacttcttcctagtttagtcttgggagggtgtgtgtgtccaggaatttatccatttcttctagattttctagtttatttgcacagaggtgtttatagtattctctgatggtagtttgtatttctgtgggatcagtgatgatatcctctttatcattttttattgtgtctatttgattcttctctcttttcttctttgttagtctggccagcggtctatctattttgttaatctgtccaaaaaaccagctcctggatttactgattctttgaagggtttttcgtgtctctatctccttcagttacactctgatcttagttatttgttgttttctgctagcatttgaatttgtttgctcctgtttctctagttcttttaattgtgatgttagggtgtcgattttagatccttcctgctttctcctgtgggcatttagtgctataaattttcctctaaacactgttttagccgtgtttcagagattctggtacactgtgtctttgttctaattggtttcaaagaacttatgtacttctgccttaatttcattatttatccagtagccattcaggagcaggttgttcagtttccatgtagttgtggggttttgagtgagtttcttaatcccgagttctaacttgattgcattgtggtctgagagactgtttgttttgatttccattcttttgcgtttactgaggagtgttttatttccaattatgtggtcaattttagaataagtgtgacgtgatgctgagaagaatgtgtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggtctctaagaacttgctttatgaatctgggtgctccagtattgggtgcatatatagttagaatagttagctcttcttgttgcattgatccctttaacattatgtaaagcccttctttgtcttctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacagcacaccgatgggtcttgactctatccaatttgccagtctgtgtcttttaattggggcatttttcccatttacatttaaggttaatattgttatgtgtgcatttgatcctgtcataatgatgctagctggttattttgcccattagttgatgcagtttcttcatagtttcaatggtcttcacaatttgatatgtttttgtagtgactggtactggtttttccttttcatatttagtgcttccttcaggagctcttgtagggcaggcctagtggtgacaaaatctctcagcatttgcttttctgtaatgaattttatttctcctttgcttatgaagcttagattgactgaatatgaaattctgggttgaaaattcttttaagaatgttgaatattgggccccactctttactggcttgtagagtttctgcagagagatgcactgttgatctgatgggcttctctttttgggtaatccgacctttctctctggctgccctcaacattttttccttcatttcagccttggtgaatctgacgattatgtgtattgagtttgcttttctcaaggagtacctttgtggtgttctctgtgtttcctgaatttgaatgttgacctgtcttgccaggttggggaagttctcctgggtaatatcctgaagagtgtttcccaacttggttccattctccccttcacttttaggtacacgaatcaaacgtacgtttggtcttttcacgtagtcccatatttcttagagtctgttcatttcttttcattcttttttctctaatcttgccttcacactttatttcattaagttgatcttcaatctctgatatcgtttcttccacttgattgatttggctattgatacttgtgaccaatctttttttgttttcttaaagcgttgagaaagcgattctttcatccagttttccattttattttatgaaggaagtttgtcaggttttactgacaattaacatagtactaatcaaaattataattattgcaactttatatgttataatttgatattataaaatattaagtatattaacagcttttcaatgcatgaaatcaatctgcagacatatatattttcaaacggataaaccatgcaggtaaaatgaaatgtgatccactttttttttcatgtctaaccttatttctttcctttatcttaaagggaaacctctcacaactatttcttatctattttgtcacagatttcccttctttgattcatgcttccacctactgcaatacggtttatagtgattaattctaccaatgcagctctcactaagatctccactgccatttatttttctgatgtagtggacagttttaatccatatttcccccaagtctattgattcttcttctaaatacatttattttcaagacacacatttatcaccattaagtctttccttcactaatgtacagttttccacccttgcttcctttgtgtctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaact

SEQ ID NO: 459 - DNA, 22787 bp, Homo sapiens
taaaataactccttcagttcaaaaattaacctttcttccttccagaaagtttgggcaagggaaaaaatggaagcatcagggcttccagataaccagtccatgggtctgaggcatgcacttgatctctcaagtcaccttctcggccctcttctaagtgtactttatttcctttcattcctgctttagagcttttaaataaacttttactcctgctctaaaacttgcctcagtctctcattctgccgtgtgcccctcagttgaattgtttattctgaggaggcaagaattgaggttgctacagactcatgtggatttgctgctggtaacatactttggtgccgtgacttggatacattctgctaataacataatttgttgctgcgtgattcagatatgttccccagttgtaagatactgcgatggctcaccttctttggctggaggtgttaaaccccagtacatggttctcttctccctttttgctctaatgctcactaaccaacccctagaattacttttctcagccgcaagtggctgttcctctgttcctccagctgatctctcagctcaacctgatgggtggctcgcaggggtgtgaaggaccttggggttcacaccaagtagacctgagacactaaacatcttcctggacaggaggcttatgagagtggtatggtgaaatcctgagaccatgcaatgtctggggtttcctctgctttttcacctaaaatcagctctttcccccaaaccttaattgcctattctcctgttttctctgtgtatattctgaaatgaccttgcatatctctgaccatctgccttgggggaagtctgactttttgctttcactttgcatgccacataacttcttaaacacacactccttgttatttgggcacctgtggctcttgctgcatttgcgtgggagcaaaaacatgggctaccttgtggatatcctctgagatttatgtttgtttttaccctaccagctcagatgacctccaacccttcccctgtctgctggcacattgctgggacagacactaattggaactctggctctgtcggctacttatgacttaccatatgtttttgttcctgttatgccccagggacaagttttccagtggcccttgaagcaatctgtccacctgcataaggcctcactctgtggccccacttgctttttctgagttagcacccctttgggaggaggagatagtctttctttgtcatttgtgagttcttaccccaagctccaactcttctagaggttactactttatgtcaagagggcaaatagacattgccctcttgaatccaagggcttttggtttggggaacatacgaaggctttccatgagtgttcctctttcttcctcctatttcttcctgtagcctccatttctcaaatcactttcacacccttctcagtatgcttcaagacctttatggtcttatttgaagggtgggggaagtctagctcccttgtggcagttagctgaaaagcaggcttcttgtctacttgaacatgagaaatgggaatctgagaaaagaaataatcattttgttgataaaatgctctgagcaaaagttactataacatcatggagacaaggataggtcagcccaagagcccaggcacaagagacccataggacagagataaaggtttgccgcaggctaatagattaccatcagaacagagatgaaggcaaggttaggggtacatggtaagactggtttattctggaaccccaaggatgaacaggggagggtcctctcttcactctggtatctcctctgttctcaagtgggtcattgtaatgagatgggaccagggttaagggcacacagtaagaccagtttattccagaaccctaaggacaaatgggggacaccccattcagtataataggaaagtaataggggacaacttcttgttcctttttcctttttttctcctctgttctctctctgcaaatgggtaatcacatctccataccacagaacacacccttaggatgcatccttaagaactggaaaaagtttaattccctgaaactttgaaaccaaaatcctagttttccactgtaatactgtttggctaaaaatgaactcagagaaaattacaaaagtcagccttggaacccagtgcctctgtgcaggagatcctcaaattagcctcctcagtcttttataactgagatcaggacaaggaagacaagcctaaggaaaaagagaaatgcagggggaaaaggcaggctgaactattggctgctctgcaatagaggctggagctctccaactccctccaggttgccctaaggacattccttcacgtaactgccactggtgtggcaatccaggccactagaagacaaactgccccggtgggataaatgggaaaaagccatgtgcagcttgccctctctgccacaagcttggccactggaatgagactgccccaagggctgaagggtccgaggaagggatcccaacctttgatggccttgagccaaaggggctctctgctatgactggcttccaaatcagaaagcatcatcaacagaacaaagccaagggcaactctggaggcagaaagtaacattgtacatttcccttttgggttcaagagctgcctactctgtgctaatatccttctctgagcaactctcctccaaatgctactgagtaatgggaaaaaatggcacctccttcatccaaaagaaaagattcgcacctctttggggaaaaatatactttcaagttggatgcctacttagtatttacacaacttttgaattcatctttccttctaatagcactatttcttccaggaaagctacctaaaacatgaacaaattaacttcaacctggaccgtcttacctcagggtttagaatagcccacacttaggttgacgagccctagcaaaaattgaactgaacaatctcttgagtggagataacttctacagtatgtaaataacctcctcatttactcccccttcacagaactggcacagcaacatgcagtaaaatccttaactttctaatagaaggaaaatgacttgtctgattcaaaggttataaaggtaaagaggtatttctgggaaggaaggttataaagaaaatggattttgtatgagaaagaattttgtttggtaaattcttgtcccaaagtaaaataactggttgtttaaaaagaaagatatttaggacaagtcagaaagtccaagtatgtcataagtggcccacgttgtgaaaagattagtgaaaggaaatttatgaaagaaatcttgtacaatttaaaggttaataggcctgctaattaactgttactatgattcttaactatacaactacttgtctgctttaaagctaggtaaggcctggtgacagagttagccatgcaccctagctatactggagtcagaccttatctgcatttctgtctggtatcctaggctcaaaacctcatatataattagaattacttacttaccagctgataagatttggctgtgtccccactaaaatatcatctcgaattgtagttcccataatccccacatgttgtggaagggacccagtgggagttaattgaatcaagggggcgattacccccatgttgctgttcttgtgatagtgagttttcatgagatctgatggttttataaggggcttttcccctttgctcagcaattctcttcctgctgccatgtaaagaaggacatgtttgcttccccttccaccatgattgtaagtttcctgaggcctctcaagccatggtgaactgtgagtcaattaaacctctttcctgtataaattactcagtctcaggtaggtctttattagcagcatgtgaacagagtgatacaccaggttttcataaaaagtttctaagagttaaacagtgtaacatgtatttgagactacttgaaaaacagttttacgtgcaaggtacgtaaggaaagtcaaatgtgcttttggtaaaagattataaaaaggcatgggaatgtggatttttgtcttgtttagaggatttaaggattgttttaatttagataggataaagctaaaggtttaaccaagttgtggaaggtttctgaaatattaatcttgcagaagaaattctgtgtgtaatcatattggctaaagttaaaggggtattattcaattttcatttaaattgagcattaaaataaaagcaaacagttttattaaagcattaatctgccctttatcaatgtgctattggtgtgtgttccaaaattacgtaaaactcctaatcccttttttttttttttttttttgagatagagtcttactctgtcacccaggctggagggcagtggtgtgaccttggctcactgcaatctctgcctcctggttcaagcaattattccacttcagcctcccaagtagctgggactacaggtgtatgccaccacacccagctaattttttgttgttactgtccttttttagcagagaatgggtttcaccatgtttgccaggctggtctcaaatttctgacctcaagtgatctgaccacctcagtctcccaaagagctgggattacaggtatgaaccatcatgcccatcctgaaactcctaatttttatataccttagtatacattatcagtaatttttccctcttgttataaagaataaaagtaattttattttgccaaatgttgatgtctatgttgagattaattcattaaatcattgaacacttcttatgcttcaagttgctgagctggtcacaggggattcaacgaagattgaaggtgtttgttagtcacacattattaacacttacaaattaatcctcatttcatctgatgagggatatctgcatttttcagatgacagggtctcattattttttatggttgaatagtactgcattgtgtgtatgaactacatttcctttaccattcatctgttagtggacacttaggttatttccaaatcttagctgttgtaaccagtgctgcaacatagtagtgtagatatctcttggacatactgatttcctttcttttgtgtacatatacagctttgggattgctggatcataaggtggcctgatttttagttttctgaggaatgttcaaattgttctccatagtggttgtactaatttaaattccaatcaacagtgtacgagatttcccttttctccacatcctcatcatcacaaattaaaaatttataaatacacatttataacactgatacaatggtagacttaaaagtcattcaaaaccttttttaaaacttgaaaaattatttcctgaacatggataaatgaaactacatcaaaattaaaaacttctgtgtctcaaagatacaatcaaaagagttaaaaaggcaatcttaaaaatggaagaaaatatttgcaaataatacatctaataaggggtaatggccagaatctataaggaacttctacaatcaacaacaaaaagcatttaacttaatttaaaaagggaaaagatttgaatagacatttatttaaagaagacatacaaatgaccaactagtatatttctatggtctgaatgttcctcctaaattcttatgctgaaatcctaacactgaagtgatggtattagaaggtaggcattttggcagcagattaaaccatgagggcagatccctcattaatgggattagcacccttataaaagagaccccagagagccaactttccttccagcatgtgaggatacctcaagaagacaccatcatttgagccaagaaatgggccctcagtggattcagaatctgcaggggccttgatgttggactttccagcttccagaactgtaagaaataaatttctcttatttgtgaattaccaagttgatggtacttgttatagcagctctaacagactaaggcacatatggaaagatgctcaacctcactaactgttaggggatacaaatcaaaatcacaatgagatatcacttcacatccatcagggtggttagtactttaaaaaacaccccaaataacaagagttggcatgatgtagagaaatggaaagacttgtgccctgtttgtgggaatataaaatgatgtagcatagttgtaatggaaaacagtgtgatgttccttaaaaacttaaaaatagaattactatataatccaaaatttccacttctgggtatatatcccaaacaatttttcaaagcagggtttgaagaaatatttatataccatgtttataaaagctttctttactgtagccaaaaggtagaagtaatccaagtgctcatcaatggatggatgaatagataaataaaatgtagtgtatacatataatggaatattattaagccttatatgcattccattaaacacatcatggaatattattcagctttttacaatggagtattatttttcataatattattcagtaaaatgtggtatatacatataatgaaatgttattcaatcttattctgacacatgctgcaacatggatgaaccttgagtacattatgctaagtgaaataagccagtcacaaaatagcaaatactgtatgattgcacctatatgaagtatctagagtagtcaaattcataaaaacagatagtagaatagtggttgccagaggcttagggatggcaggagctggaaggagtggagagatgttatttaaggagcatagaatttcagttttgcaagatggaaaagtctggagattagttccataatgctgtgaatgcagttaatactactgaactgtataccaaaaaatggttaaggtggtaaattttctgctaactgtactttatcttaattttaaaaataggtaacaagggcaacattattccttggaaaacaatgctaaaatataacttagctaaattcagcccagccaagcagtgattaaaggatgaggtagaggggaatcaacattggagaagggatgtagaccaaaagcagcagatgggcatgggctcgaggaaaagtcatcattcctggtctaggggttggctttcagatttgattattctaggcttcagagttaagaaggacataaccaagtcacaagagtttatatacagaaaggtaaatttttgaaagtacagtattctctgtggataataggtaagtgttaattgcactaagttctttcctagtggattaatatatccagaagatcaataatttccttgttgtgactgtcacaaaaagcaaggaaatacatgatttcaaacaatgcttctcccacattgtttaacttaacagaattaaataacgagaatagtgttaatacgaagaatgaaatagctaaattctagaaaatgtttattgtcagtcacacattgttaacacttacaaattaatcctcatttcacctcatgaggaatacctgcatttttcatatttattgaatgtgtaccagtggccaattccatttagtccctatagatatcagtgtctctgatggttaattttaggtgtaaacttgattgcattaggaatacctagcaattttggtcaagcattattttggggtgtatcccagggtgtttccagaggagattagcatatgtgtcttaatgggctaagtggggaagatccaccttcagtgtgggtgggcaccatgtgatctgctgggaatctagagagaacgaaactgataaaagacagatgcgtggatctatccactgaaaccatgatgcactctttctcccctgtccttcaacaacaagtccaagctccccgatctttggactccagggcttaaaccagaagcccttcggttctcaggactttggcctgggactgagaatttcattatccacttcccttattctgaggccttcagacttgaactgagccacactaccagcatcctagggtctccatatttattatatgtaattattatatatatttattacatctatatacatatatatactgattttgtcttgctggagaaccgtgagtagcacagtgaccaaagcggacagtggtaagttatattattattcctatttacagaagaaaatacagaagtatagggagttattgaattgtggagccactgttggaatgcagaaaatctgactctgaatcctcagctcttacatgctcttgggacatgttttggtcaaaagaaccagaggtgatttctagactgatcaatgcttttccagtagagtcctgcctaaggaataaaaaagtcattctcttcagctgttatgcttcttcactgtaaagtcccatttgcttatgccagatgtgtttcataatgaatatattgagccctattttacttacacatgttctatcctagttttgtctccttgagaatttatctttataaattcaaatacatttgaaaaataatttgttcatcccagtaatatacacaacataatcatggtacaattattcaaacaaataaattaacattgatattatattaccatctaaactttagatttcatccgtttttttcattaacattatttttctgtttcaagaatcaatccaggatcccacactgcatttatttgttttatttctttagtctcctccaatctataacacatgctcagtctttcctagtctttcattatcttgaggcttttaaataaaattgatcagctgttttgtagaatgtccatcaatttggatatgtgtggtattttctcatgataacattgaatttacagatttaagagaagcataccccatcattgccaagatcttggcctgcctgcctatgtgtacaaacatgtatgacctacccaggcacagagacaaaagaagctctttcccctggtcccagagtgcacattcagttcatttgtgcatatacccatgtctaggtgtcttgatggctattgagggagttggtgtggtaccctagtgctattagtgcaggacacagcttgcttaacatggaatcacagcaacccttttaaaaggcataggtggaatttccattcacataaggtttgtgtttgcatgtgtttttgactttttaaagacttaattgtcacaagtttcatgattaactgtcacaggctgctatataacaaaactttagctactcacattcatgcctaatagttctaatatattatttatctaggtttgatatccttgtttcatggaccctgttagagcaaactaaatacagcttgagaaggactccatacttctatatttaagtccttgtggatgaactgcaacctaatttaataggtagacaagattgaaaacctaacttaagaatatgagtctgtatcaatagctgagtcttgaccaatcccagcagccatacctcaaccagtcatacactgctgagtgttcaaactgtgttcaaataaggcaaatgccaagctgtaaccaatctagctgtttttgtagctcacttctgatttctgtacgtcattttactttttttgtctataaatttgttctgactacaaggcaaccctggtgtctttctgaatctgctgtgattctgggggctacccaattcatgaatcgttcgttgctcaattaaactcctttcaatttaatttggctgaagtttttcttttaacaaccttaatcctcaggaagggtttctaattctaaatgtaactacttagtgcaaagtgcaccaactggaaagaaaataaagataattaaagtgtcattgtcttctcaactaagttaaatgaatgaattttgcaaaggtctttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaacctatgctgaagacactgatgttggccacatctccatgaggaaactctgtgctcttagcaaccactttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtgggcagggtgctttccactaaccatggttgtgctgaattggacttccttgggttgtaacccttgtagctcatgaatcacctggcaggaaggagaagcaaagccatgctcaccccttgccctgaggcttcagaaacttggctgtctccagctggtgctgcatagtgattgatccttagccaagtcttcctgtgcaccagggggctctccatgccctttttaggtttactagatgcactttacctggggtgggggtggaggaagtaaagtgaagttcgcagcaggacctgggggcaagggtcagccacctcagtgctcatgcactccattgcactccctgcccaggttcctccagatttgccactcagttccccaatactgtagcatatataacatgtaaattataaacataaaattataaggcccccaaaccacctgaatgaacttcctcctctgacagggtattcttaaaatttaacctgaaagactggttcaggcatgacagttggacatgcttcattggaactctccctggcattaacatcaacacagaacttaagtctcataagaagcttttacaatctattctctctgaagcctgctacctggaagcttcatctgcataaaattttggtctctacaacttattgcaacccaggctttcctttctattaataataactctttcaaccaattaccagtcagaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccaagtgtcacaggcaatggtcactcatatttggctcagaataaatctcttcaaatattttatgaaatttgactcttttcattgacaatagctccaggatataaaaaatatatggctgtagcttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactctaacccatcaataggagaaaaggaatttaaaattgggtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcatgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttccccacatagccatccattgccaaaaaaagttaaaatgtgcctgaggctgggagtattttctctaagatacaaacattaagaaaaagtgcttattcccatactggggtcagttcctgacaggaaagagcctctttttaactctgaaatgaaatctcctgccagggacacacttctgcataagcagaaaagctgctcctcacagacttggccgctgtcttggtgcattttggtcatcggtggctctcttttcctgtaaatgttttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgctggagattttataggataaaatctatgctgtctgttgaagagggctttgtgtggtattgataacacaaaggttgcagtgagctaacttgcagatgtctactgatagctgggtacagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcattataaaagggacattccctctttttccagaaatattcctaagaaaagaaaaacagcctgttatataagagtgtctgaaaaaactagaactttcactcaaggtcggctttaatttgcagttttgtattcataaggggaaagtgatgggcaaaccccacaagagaacagaaatcagctgtgtgaataggcactgcaggctaatgaagagtgaagaggagagcacagtgggaatttctagaggaagagaaaggaatctaatgtgatatgggagtgaaaaatgggatccagaaaagcagagaggaaatggggaagtggaccaggtctcagaaccagcaaaggctactatgtatatttcacttagtttaggagactaacttcatatgggagcgtatgctggaattctgagagccagaaaaggaacgtgccaggtgccagaatcagttaataggcattatgtgtcttctgcatttcaatctacatgctgcttcttttctttcaggtattcatacaaaccaacatttcctgactgaatgcaaataggacacttctttgaaatgaggagcgacaaatttttaacctttctagaattcatgacagaatactgttttttttttttttttaacgctgtctccattgaaagtcagttactgaatggtaggacacaattcttatgaattttgtagaaagacaaataatattctcatctacaactgtgtgaagaaaaatagaaaaatacttgccatgtgttaaatccttacactatggagaatactatgcaaactgctttcaactgcctgcgttcatttaagaatcacaacaactatgtaagtatttctaatcctttctatttataagaaactgaggctcagagatattaagtgctttttttcaacatcacacatacatgcaaacagagtgaaatttcaatgttaaattttttattgttatttacaactaatgtgtaagctttgtattgggaatttctgcaataattttaactctcttttgattcctggattatacacaactctctcctgctctctgtatatccttggttcatgttgtattttcggctgattttgaccaatcttttattttattttgtatttttatttattatttacttattttttgaggcagagtctcactctgtcacccaggctggagtgcagtgacgctatctgggctcactgcaagctccgcttccagggttcacgccattctcctgcctcagcctcccaagtagctgggactacagaaacccgccactacgcccggctaatttttttgtatttttagtagagaaggggtttcactgcgttagccaggatggtctcgatctcctgacctcatgatccgcccacctcggcctcccaaaatgctgggattgcaggcgtgagccaccgcgcctgggccctatgttttgttttgttttgttttttattattatactttaagttctgggatacatgtgcagaatgtgcaggtttgttacataggtatacatgggccatggtgatttgctgcacccatcaactcgtcgtctccattaggtatttctcctaatgctatccttcccctagcccccacccccaacaggctccagtgtgtgatgtttcccttcctgcgtccacgtgttctcattgttcaactcctatttatgagtgacaacatgtggtgtttggttttctgttcctgtgttaatttgctgagaatgatggtttccagcttcatccatgtccctgtaaaagacatgaactcatcctttttatggctgcatagtattccatggtgtataggtgccacattttctttatgcagtctatcattgatgggcgtttgggttggttccaagcctttgctattgtgaacagtgttgcaataaacgtatgtgtgcatgtgtctttatagtagaatgatttataatcctttgggtatatacccagtaacgggattgctgggtcaaatggtatttctggttctaggtccttgaggaatccccacactgtcttccacaatgtttgacctaatttacactcccaccaacagtgtaaaagtgttcctatttctccacaccctctccagcatctgttgtttcctgacttttttaatgattgccattctaactggcgtgagattgtatctcactgtggttttgatatgcatttctctactgaccagtgctgatgagcttttttttcatgtgtctgttggctgcataaatgtcttcttttgcgaagtgtgtgttcatatccttcaccccctttttggtgttttttttttttttttttttttttttttgtaaatttgtttaagttccttgtagattctggatattagctctttgtcagatgaatggattgcaacagttttctcccattctgcaggttgcctgttcactctgatgatagtttcttttgctgtgcagaagctctttagtttaattagatcccatttgtcagttttggcctctgttgccattgcttttgatgttttagtcttgaagtctttgtccatgcctatgtcctgaatggtatcgcctaggttttcttctagggtttttttggttttaggtcttacatttaagtctttaatcgatcttgagttaatttttgtacaaggtgtaaagaaggggtccagtttcagttttctgcatatggctagcaagttttcccaacacaatgtattaaatagggaatcctttccccatttattgtttttgtcaggtttgtcaaagatcagatggttgtagatgtgtggtattatttctgaggcctctgttctgttccatggttctatttatctgttttggtaccagtaccatgctgttttggttactgtagccttgaagtatagtttgaagttaggtagtgtggtgcctccagatttgttctttttgcttaggattgtcttgactatatgggctcttttttggttccataagaaatttaaagtagttttttctaattatgtgaacaaagtgaaaggtagcttgatggggatagcatctataaattaccttgggcagtatggccattttcacactattgattcttcctatccatgagcatggaatgtttttccacttgtttgtttcctgtcttattttgttgagcagtggtttgtagttcttgacgaggtcctttccacttgtttgtttcctctcctatttccttgagcagtggtttgtagttctccttgaagaggtccttcacatccattgtaagttgtattcctaggcactttattctctttgtagcaattgtgaatgagagttcagtcatgatttggctctctattattggtgtataggagtgcttgtaatttttgcacattgattttgtatcctgcgactttgctgaagttgcttatcagcttaaggagattttggactgagacaatagggttttctaaatatatactcgtgtcttctgcaaatagagaccatttgacttcctctcttcctatttgaacactctttatttctttctcttgcctgattgccctggacagaacttccaatactatgttgaataggagtgatgagagagagcattcttgtcttgtgccagttttcaaaaggaatgcttccagcttttgcccattccatatgatattgactgtgggtttgtcatgaatagctctcattattttgagatgcattccaccaatacctagtttattgagagtttttagcatgaaggggtgttgaattttatcaaggccttttctgcatctattgagataatcatgtggtttttgtcgttggttctgtttatgtgatggattacgtttattgatttgcatatgttgaaccagccttgcatcccaggaatgaagccgacttggtcttggtggataagctctttgatgtgttgctggatttggtttcccagtattttattgaggatttttgcattgatgttcatcagagatattgacttgacatttctttttttttgatgtgtctctgccagtttttggtattaggatgatgctgacctcataaaatgagttagggaggagcccttctttttctattgtttggcatagtttcagaaggaatggtaccagctcctctttgtacctctggtacaatttggctgtgaatccgtcttgtcctggactttttttgttggtaatctattaattactgcctcaatttcagaagttgttattggtctactcagggattcgacttcttttttttttcaattttttttttattatactttaagttctagggtacatgtgcacaatgtgcaggtttgttacatatgtatacatgtgctatgttggtgtgctgcacccattaactcgccatttacattaagtatatctcctaatgctatccctccccactcccccaaccccacaacaggccccagtatgtgatgttccccttcctgtgtccaagtgttctcgttgttcaattcccacctatgagtgagaacatgcagagtttggttttctgtcctagcgatagtttgctgagaatgatggtttacagcgtcatccatgtccctacaaatgacatgaactcctccttttttatgactgcatagtattccatggtgtatatatgccacattttcttaatccagtctatcattgatggacatttgggttggctctaagtctttgctattgtgaatagtgccacaataaacataagtgtgcatgtgtctttgtaacagcatgatttataatcctttgggtatatacccagtaatgggatggctggttcaaatggtatttctagctctgatcgccatgctgccctccgcaatggttgaactagtttacagccccaccaacagtataaaagtattcctatttctccaaatcctcaccagcacctgttgcttcctgactttttaatgatcgccattctaactggtgtgagatggtatctcattttggttttgatttgcatttctctgatggccagtgatgatgagcattttgtcatgtgtttgttggctgcataaatgtctttttttgagaagcgtctgttcctatcctttgcccactttttgatggggttgtttgatttttttcttgtaaatttgcttaagttctttgtagattcttgatattagccctttgtcagatgggtagattgcaaaaattttctcccattctgtaggttgcctgttcaatctgatggtagtttcttttgctgtgcagaagctctttagtttaattagatcccatttgtcaattttgacttttgttgccattgcttttggtgttgtagtcatgaagtccttgcccatgcctatgtcctgtatggtattgcctaggttttcttctggggtttttatggttttaggtctaacatttaagtctttaattcatcttgaattaatttttgttctgccctctcttaccactcctattcaacataatgttggaagttctggccagggaaatcaggcaggagaaagaaataaagggtattcaattaggaaaagaggaagtcaaatcgtctctgtttgcagaagacatgattgcatatttagaaaacccaaacacttcagcccaaaatctccttaagctgataagcaacttaagcagtctcaggatacaaaatcaatgtgcaaaaatcacaagcattcctgtacaccagtaacagacagagagccaaatcatgagtgaactcccattcacaattgcttcaaagagaataaaatacctaggaatccaacttacaagggatgtgaagcacctcttcaaggagaactgcaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctactgatgactttcttcacataattggaaaaaactactttaaagttcatatggaaccagaaaagagcccgcattgccaagccaatcctaagtcaaaagaacaaagctggaggcatcacgctacctgacttcaaactatacttcaaggctacagtaaccaaaacagcatggtactggtaccaaaatagagatatagaccaatggaacagaacagagccctcagaaataataccacacatctacaaccatctgatctttgacaaacctgacgaaaacaagaaatggagaaaggattccctgtttaataaatggtgctaggaaaactggctagccatatgtagaaagctgaaatgggattcaacttcttcctagtttagtcttgggagggtgtgtgtgtccaggaatttatccatttcttctagattttctagtttatttgcacagaggtgtttatagtattctctgatggtagtttgtatttctgtgggatcagtgatgatatcctctttatcattttttattgtgtctatttgattcttctctcttttcttctttgttagtctggccagcggtctatctattttgttaatctgtccaaaaaaccagctcctggatttactgattctttgaagggtttttcgtgtctctatctccttcagttacactctgatcttagttatttgttgttttctgctagcatttgaatttgtttgctcctgtttctctagttcttttaattgtgatgttagggtgtcgattttagatccttcctgctttctcctgtgggcatttagtgctataaattttcctctaaacactgttttagccgtgtttcagagattctggtacactgtgtctttgttctaattggtttcaaagaacttatgtacttctgccttaatttcattatttatccagtagccattcaggagcaggttgttcagtttccatgtagttgtggggttttgagtgagtttcttaatcccgagttctaacttgattgcattgtggtctgagagactgtttgttttgatttccattcttttgcgtttactgaggagtgttttatttccaattatgtggtcaattttagaataagtgtgacgtgatgctgagaagaatgtgtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggtctctaagaacttgctttatgaatctgggtgctccagtattgggtgcatatatagttagaatagttagctcttcttgttgcattgatccctttaacattatgtaaagcccttctttgtcttctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacagcacaccgatgggtcttgactctatccaatttgccagtctgtgtcttttaattggggcatttttcccatttacatttaaggttaatattgttatgtgtgcatttgatcctgtcataatgatgctagctggttattttgcccattagttgatgcagtttcttcatagtttcaatggtcttcacaatttgatatgtttttgtagtgactggtactggtttttccttttcatatttagtgcttccttcaggagctcttgtagggcaggcctagtggtgacaaaatctctcagcatttgcttttctgtaatgaattttatttctcctttgcttatgaagcttagattgactgaatatgaaattctgggttgaaaattcttttaagaatgttgaatattgggccccactctttactggcttgtagagtttctgcagagagatgcactgttgatctgatgggcttctctttttgggtaatccgacctttctctctggctgccctcaacattttttccttcatttcagccttggtgaatctgacgattatgtgtattgagtttgcttttctcaaggagtacctttgtggtgttctctgtgtttcctgaatttgaatgttgacctgtcttgccaggttggggaagttctcctgggtaatatcctgaagagtgtttcccaacttggttccattctccccttcacttttaggtacacgaatcaaacgtacgtttggtcttttcacgtagtcccatatttcttagagtctgttcatttcttttcattcttttttctctaatcttgccttcacactttatttcattaagttgatcttcaatctctgatatcgtttcttccacttgattgatttggctattgatacttgtgaccaatctttttttgttttcttaaagcgttgagaaagcgattctttcatccagttttccattttattttatgaaggaagtttgtcaggttttactgacaattaacatagtactaatcaaaattataattattgcaactttatatgttataatttgatattataaaatattaagtatattaacagcttttcaatgcatgaaatcaatctgcagacatatatattttcaaacggataaaccatgcaggtaaaatgaaatgtgatccactttttttttcatgtctaaccttatttctttcctttatcttaaagggaaacctctcacaactatttcttatctattttgtcacagatttcccttctttgattcatgcttccacctactgcaatacggtttatagtgattaattctaccaatgcagctctcactaagatctccactgccatttatttttctgatgtagtggacagttttaatccatatttcccccaagtctattgattcttcttctaaatacatttattttcaagacacacatttatcaccattaagtctttccttcactaatgtacagttttccacccttgcttcctttgtgtctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaact

SEQ ID NO: 460 - DNA, 28862 bp, Homo sapiens
taaaataactccttcagttcaaaaattaacctttcttccttccagaaagtttgggcaagggaaaaaatggaagcatcagggcttccagataaccagtccatgggtctgaggcatgcacttgatctctcaagtcaccttctcggccctcttctaagtgtactttatttcctttcattcctgctttagagcttttaaataaacttttactcctgctctaaaacttgcctcagtctctcattctgccgtgtgcccctcagttgaattgtttattctgaggaggcaagaattgaggttgctacagactcatgtggatttgctgctggtaacatactttggtgccgtgacttggatacattctgctaataacataatttgttgctgcgtgattcagatatgttccccagttgtaagatactgcgatggctcaccttctttggctggaggtgttaaaccccagtacatggttctcttctccctttttgctctaatgctcactaaccaacccctagaattacttttctcagccgcaagtggctgttcctctgttcctccagctgatctctcagctcaacctgatgggtggctcgcaggggtgtgaaggaccttggggttcacaccaagtagacctgagacactaaacatcttcctggacaggaggcttatgagagtggtatggtgaaatcctgagaccatgcaatgtctggggtttcctctgctttttcacctaaaatcagctctttcccccaaaccttaattgcctattctcctgttttctctgtgtatattctgaaatgaccttgcatatctctgaccatctgccttgggggaagtctgactttttgctttcactttgcatgccacataacttcttaaacacacactccttgttatttgggcacctgtggctcttgctgcatttgcgtgggagcaaaaacatgggctaccttgtggatatcctctgagatttatgtttgtttttaccctaccagctcagatgacctccaacccttcccctgtctgctggcacattgctgggacagacactaattggaactctggctctgtcggctacttatgacttaccatatgtttttgttcctgttatgccccagggacaagttttccagtggcccttgaagcaatctgtccacctgcataaggcctcactctgtggccccacttgctttttctgagttagcacccctttgggaggaggagatagtctttctttgtcatttgtgagttcttaccccaagctccaactcttctagaggttactactttatgtcaagagggcaaatagacattgccctcttgaatccaagggcttttggtttggggaacatacgaaggctttccatgagtgttcctctttcttcctcctatttcttcctgtagcctccatttctcaaatcactttcacacccttctcagtatgcttcaagacctttatggtcttatttgaagggtgggggaagtctagctcccttgtggcagttagctgaaaagcaggcttcttgtctacttgaacatgagaaatgggaatctgagaaaagaaataatcattttgttgataaaatgctctgagcaaaagttactataacatcatggagacaaggataggtcagcccaagagcccaggcacaagagacccataggacagagataaaggtttgccgcaggctaatagattaccatcagaacagagatgaaggcaaggttaggggtacatggtaagactggtttattctggaaccccaaggatgaacaggggagggtcctctcttcactctggtatctcctctgttctcaagtgggtcattgtaatgagatgggaccagggttaagggcacacagtaagaccagtttattccagaaccctaaggacaaatgggggacaccccattcagtataataggaaagtaataggggacaacttcttgttcctttttcctttttttctcctctgttctctctctgcaaatgggtaatcacatctccataccacagaacacacccttaggatgcatccttaagaactggaaaaagtttaattccctgaaactttgaaaccaaaatcctagttttccactgtaatactgtttggctaaaaatgaactcagagaaaattacaaaagtcagccttggaacccagtgcctctgtgcaggagatcctcaaattagcctcctcagtcttttataactgagatcaggacaaggaagacaagcctaaggaaaaagagaaatgcagggggaaaaggcaggctgaactattggctgctctgcaatagaggctggagctctccaactccctccaggttgccctaaggacattccttcacgtaactgccactggtgtggcaatccaggccactagaagacaaactgccccggtgggataaatgggaaaaagccatgtgcagcttgccctctctgccacaagcttggccactggaatgagactgccccaagggctgaagggtccgaggaagggatcccaacctttgatggccttgagccaaaggggctctctgctatgactggcttccaaatcagaaagcatcatcaacagaacaaagccaagggcaactctggaggcagaaagtaacattgtacatttcccttttgggttcaagagctgcctactctgtgctaatatccttctctgagcaactctcctccaaatgctactgagtaatgggaaaaaatggcacctccttcatccaaaagaaaagattcgcacctctttggggaaaaatatactttcaagttggatgcctacttagtatttacacaacttttgaattcatctttccttctaatagcactatttcttccaggaaagctacctaaaacatgaacaaattaacttcaacctggaccgtcttacctcagggtttagaatagcccacacttaggttgacgagccctagcaaaaattgaactgaacaatctcttgagtggagataacttctacagtatgtaaataacctcctcatttactcccccttcacagaactggcacagcaacatgcagtaaaatccttaactttctaatagaaggaaaatgacttgtctgattcaaaggttataaaggtaaagaggtatttctgggaaggaaggttataaagaaaatggattttgtatgagaaagaattttgtttggtaaattcttgtcccaaagtaaaataactggttgtttaaaaagaaagatatttaggacaagtcagaaagtccaagtatgtcataagtggcccacgttgtgaaaagattagtgaaaggaaatttatgaaagaaatcttgtacaatttaaaggttaataggcctgctaattaactgttactatgattcttaactatacaactacttgtctgctttaaagctaggtaaggcctggtgacagagttagccatgcaccctagctatactggagtcagaccttatctgcatttctgtctggtatcctaggctcaaaacctcatatataattagaattacttacttaccagctgataagatttggctgtgtccccactaaaatatcatctcgaattgtagttcccataatccccacatgttgtggaagggacccagtgggagttaattgaatcaagggggcgattacccccatgttgctgttcttgtgatagtgagttttcatgagatctgatggttttataaggggcttttcccctttgctcagcaattctcttcctgctgccatgtaaagaaggacatgtttgcttccccttccaccatgattgtaagtttcctgaggcctctcaagccatggtgaactgtgagtcaattaaacctctttcctgtataaattactcagtctcaggtaggtctttattagcagcatgtgaacagagtgatacaccaggttttcataaaaagtttctaagagttaaacagtgtaacatgtatttgagactacttgaaaaacagttttacgtgcaaggtacgtaaggaaagtcaaatgtgcttttggtaaaagattataaaaaggcatgggaatgtggatttttgtcttgtttagaggatttaaggattgttttaatttagataggataaagctaaaggtttaaccaagttgtggaaggtttctgaaatattaatcttgcagaagaaattctgtgtgtaatcatattggctaaagttaaaggggtattattcaattttcatttaaattgagcattaaaataaaagcaaacagttttattaaagcattaatctgccctttatcaatgtgctattggtgtgtgttccaaaattacgtaaaactcctaatcccttttttttttttttttttttgagatagagtcttactctgtcacccaggctggagggcagtggtgtgaccttggctcactgcaatctctgcctcctggttcaagcaattattccacttcagcctcccaagtagctgggactacaggtgtatgccaccacacccagctaattttttgttgttactgtccttttttagcagagaatgggtttcaccatgtttgccaggctggtctcaaatttctgacctcaagtgatctgaccacctcagtctcccaaagagctgggattacaggtatgaaccatcatgcccatcctgaaactcctaatttttatataccttagtatacattatcagtaatttttccctcttgttataaagaataaaagtaattttattttgccaaatgttgatgtctatgttgagattaattcattaaatcattgaacacttcttatgcttcaagttgctgagctggtcacaggggattcaacgaagattgaaggtgtttgttagtcacacattattaacacttacaaattaatcctcatttcatctgatgagggatatctgcatttttcagatgacagggtctcattattttttatggttgaatagtactgcattgtgtgtatgaactacatttcctttaccattcatctgttagtggacacttaggttatttccaaatcttagctgttgtaaccagtgctgcaacatagtagtgtagatatctcttggacatactgatttcctttcttttgtgtacatatacagctttgggattgctggatcataaggtggcctgatttttagttttctgaggaatgttcaaattgttctccatagtggttgtactaatttaaattccaatcaacagtgtacgagatttcccttttctccacatcctcatcatcacaaattaaaaatttataaatacacatttataacactgatacaatggtagacttaaaagtcattcaaaaccttttttaaaacttgaaaaattatttcctgaacatggataaatgaaactacatcaaaattaaaaacttctgtgtctcaaagatacaatcaaaagagttaaaaaggcaatcttaaaaatggaagaaaatatttgcaaataatacatctaataaggggtaatggccagaatctataaggaacttctacaatcaacaacaaaaagcatttaacttaatttaaaaagggaaaagatttgaatagacatttatttaaagaagacatacaaatgaccaactagtatatttctatggtctgaatgttcctcctaaattcttatgctgaaatcctaacactgaagtgatggtattagaaggtaggcattttggcagcagattaaaccatgagggcagatccctcattaatgggattagcacccttataaaagagaccccagagagccaactttccttccagcatgtgaggatacctcaagaagacaccatcatttgagccaagaaatgggccctcagtggattcagaatctgcaggggccttgatgttggactttccagcttccagaactgtaagaaataaatttctcttatttgtgaattaccaagttgatggtacttgttatagcagctctaacagactaaggcacatatggaaagatgctcaacctcactaactgttaggggatacaaatcaaaatcacaatgagatatcacttcacatccatcagggtggttagtactttaaaaaacaccccaaataacaagagttggcatgatgtagagaaatggaaagacttgtgccctgtttgtgggaatataaaatgatgtagcatagttgtaatggaaaacagtgtgatgttccttaaaaacttaaaaatagaattactatataatccaaaatttccacttctgggtatatatcccaaacaatttttcaaagcagggtttgaagaaatatttatataccatgtttataaaagctttctttactgtagccaaaaggtagaagtaatccaagtgctcatcaatggatggatgaatagataaataaaatgtagtgtatacatataatggaatattattaagccttatatgcattccattaaacacatcatggaatattattcagctttttacaatggagtattatttttcataatattattcagtaaaatgtggtatatacatataatgaaatgttattcaatcttattctgacacatgctgcaacatggatgaaccttgagtacattatgctaagtgaaataagccagtcacaaaatagcaaatactgtatgattgcacctatatgaagtatctagagtagtcaaattcataaaaacagatagtagaatagtggttgccagaggcttagggatggcaggagctggaaggagtggagagatgttatttaaggagcatagaatttcagttttgcaagatggaaaagtctggagattagttccataatgctgtgaatgcagttaatactactgaactgtataccaaaaaatggttaaggtggtaaattttctgctaactgtactttatcttaattttaaaaataggtaacaagggcaacattattccttggaaaacaatgctaaaatataacttagctaaattcagcccagccaagcagtgattaaaggatgaggtagaggggaatcaacattggagaagggatgtagaccaaaagcagcagatgggcatgggctcgaggaaaagtcatcattcctggtctaggggttggctttcagatttgattattctaggcttcagagttaagaaggacataaccaagtcacaagagtttatatacagaaaggtaaatttttgaaagtacagtattctctgtggataataggtaagtgttaattgcactaagttctttcctagtggattaatatatccagaagatcaataatttccttgttgtgactgtcacaaaaagcaaggaaatacatgatttcaaacaatgcttctcccacattgtttaacttaacagaattaaataacgagaatagtgttaatacgaagaatgaaatagctaaattctagaaaatgtttattgtcagtcacacattgttaacacttacaaattaatcctcatttcacctcatgaggaatacctgcatttttcatatttattgaatgtgtaccagtggccaattccatttagtccctatagatatcagtgtctctgatggttaattttaggtgtaaacttgattgcattaggaatacctagcaattttggtcaagcattattttggggtgtatcccagggtgtttccagaggagattagcatatgtgtcttaatgggctaagtggggaagatccaccttcagtgtgggtgggcaccatgtgatctgctgggaatctagagagaacgaaactgataaaagacagatgcgtggatctatccactgaaaccatgatgcactctttctcccctgtccttcaacaacaagtccaagctccccgatctttggactccagggcttaaaccagaagcccttcggttctcaggactttggcctgggactgagaatttcattatccacttcccttattctgaggccttcagacttgaactgagccacactaccagcatcctagggtctccatatttattatatgtaattattatatatatttattacatctatatacatatatatactgattttgtcttgctggagaaccgtgagtagcacagtgaccaaagcggacagtggtaagttatattattattcctatttacagaagaaaatacagaagtatagggagttattgaattgtggagccactgttggaatgcagaaaatctgactctgaatcctcagctcttacatgctcttgggacatgttttggtcaaaagaaccagaggtgatttctagactgatcaatgcttttccagtagagtcctgcctaaggaataaaaaagtcattctcttcagctgttatgcttcttcactgtaaagtcccatttgcttatgccagatgtgtttcataatgaatatattgagccctattttacttacacatgttctatcctagttttgtctccttgagaatttatctttataaattcaaatacatttgaaaaataatttgttcatcccagtaatatacacaacataatcatggtacaattattcaaacaaataaattaacattgatattatattaccatctaaactttagatttcatccgtttttttcattaacattatttttctgtttcaagaatcaatccaggatcccacactgcatttatttgttttatttctttagtctcctccaatctataacacatgctcagtctttcctagtctttcattatcttgaggcttttaaataaaattgatcagctgttttgtagaatgtccatcaatttggatatgtgtggtattttctcatgataacattgaatttacagatttaagagaagcataccccatcattgccaagatcttggcctgcctgcctatgtgtacaaacatgtatgacctacccaggcacagagacaaaagaagctctttcccctggtcccagagtgcacattcagttcatttgtgcatatacccatgtctaggtgtcttgatggctattgagggagttggtgtggtaccctagtgctattagtgcaggacacagcttgcttaacatggaatcacagcaacccttttaaaaggcataggtggaatttccattcacataaggtttgtgtttgcatgtgtttttgactttttaaagacttaattgtcacaagtttcatgattaactgtcacaggctgctatataacaaaactttagctactcacattcatgcctaatagttctaatatattatttatctaggtttgatatccttgtttcatggaccctgttagagcaaactaaatacagcttgagaaggactccatacttctatatttaagtccttgtggatgaactgcaacctaatttaataggtagacaagattgaaaacctaacttaagaatatgagtctgtatcaatagctgagtcttgaccaatcccagcagccatacctcaaccagtcatacactgctgagtgttcaaactgtgttcaaataaggcaaatgccaagctgtaaccaatctagctgtttttgtagctcacttctgatttctgtacgtcattttactttttttgtctataaatttgttctgactacaaggcaaccctggtgtctttctgaatctgctgtgattctgggggctacccaattcatgaatcgttcgttgctcaattaaactcctttcaatttaatttggctgaagtttttcttttaacaaccttaatcctcaggaagggtttctaattctaaatgtaactacttagtgcaaagtgcaccaactggaaagaaaataaagataattaaagtgtcattgtcttctcaactaagttaaatgaatgaattttgcaaaggtctttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaacctatgctgaagacactgatgttggccacatctccatgaggaaactctgtgctcttagcaaccactttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtgggcagggtgctttccactaaccatggttgtgctgaattggacttccttgggttgtaacccttgtagctcatgaatcacctggcaggaaggagaagcaaagccatgctcaccccttgccctgaggcttcagaaacttggctgtctccagctggtgctgcatagtgattgatccttagccaagtcttcctgtgcaccagggggctctccatgccctttttaggtttactagatgcactttacctggggtgggggtggaggaagtaaagtgaagttcgcagcaggacctgggggcaagggtcagccacctcagtgctcatgcactccattgcactccctgcccaggttcctccagatttgccactcagttccccaatactgtagcatatataacatgtaaattataaacataaaattataaggcccccaaaccacctgaatgaacttcctcctctgacagggtattcttaaaatttaacctgaaagactggttcaggcatgacagttggacatgcttcattggaactctccctggcattaacatcaacacagaacttaagtctcataagaagcttttacaatctattctctctgaagcctgctacctggaagcttcatctgcataaaattttggtctctacaacttattgcaacccaggctttcctttctattaataataactctttcaaccaattaccagtcagaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccaagtgtcacaggcaatggtcactcatatttggctcagaataaatctcttcaaatattttatgaaatttgactcttttcattgacaatagctccaggatataaaaaatatatggctgtagcttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactctaacccatcaataggagaaaaggaatttaaaattgggtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcatgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttccccacatagccatccattgccaaaaaaagttaaaatgtgcctgaggctgggagtattttctctaagatacaaacattaagaaaaagtgcttattcccatactggggtcagttcctgacaggaaagagcctctttttaactctgaaatgaaatctcctgccagggacacacttctgcataagcagaaaagctgctcctcacagacttggccgctgtcttggtgcattttggtcatcggtggctctcttttcctgtaaatgttttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgctggagattttataggataaaatctatgctgtctgttgaagagggctttgtgtggtattgataacacaaaggttgcagtgagctaacttgcagatgtctactgatagctgggtacagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcattataaaagggacattccctctttttccagaaatattcctaagaaaagaaaaacagcctgttatataagagtgtctgaaaaaactagaactttcactcaaggtcggctttaatttgcagttttgtattcataaggggaaagtgatgggcaaaccccacaagagaacagaaatcagctgtgtgaataggcactgcaggctaatgaagagtgaagaggagagcacagtgggaatttctagaggaagagaaaggaatctaatgtgatatgggagtgaaaaatgggatccagaaaagcagagaggaaatggggaagtggaccaggtctcagaaccagcaaaggctactatgtatatttcacttagtttaggagactaacttcatatgggagcgtatgctggaattctgagagccagaaaaggaacgtgccaggtgccagaatcagttaataggcattatgtgtcttctgcatttcaatctacatgctgcttcttttctttcaggtattcatacaaaccaacatttcctgactgaatgcaaataggacacttctttgaaatgaggagcgacaaatttttaacctttctagaattcatgacagaatactgttttttttttttttttaacgctgtctccattgaaagtcagttactgaatggtaggacacaattcttatgaattttgtagaaagacaaataatattctcatctacaactgtgtgaagaaaaatagaaaaatacttgccatgtgttaaatccttacactatggagaatactatgcaaactgctttcaactgcctgcgttcatttaagaatcacaacaactatgtaagtatttctaatcctttctatttataagaaactgaggctcagagatattaagtgctttttttcaacatcacacatacatgcaaacagagtgaaatttcaatgttaaattttttattgttatttacaactaatgtgtaagctttgtattgggaatttctgcaataattttaactctcttttgattcctggattatacacaactctctcctgctctctgtatatccttggttcatgttgtattttcggctgattttgaccaatcttttattttattttgtatttttatttattatttacttattttttgaggcagagtctcactctgtcacccaggctggagtgcagtgacgctatctgggctcactgcaagctccgcttccagggttcacgccattctcctgcctcagcctcccaagtagctgggactacagaaacccgccactacgcccggctaatttttttgtatttttagtagagaaggggtttcactgcgttagccaggatggtctcgatctcctgacctcatgatccgcccacctcggcctcccaaaatgctgggattgcaggcgtgagccaccgcgcctgggccctatgttttgttttgttttgttttttattattatactttaagttctgggatacatgtgcagaatgtgcaggtttgttacataggtatacatgggccatggtgatttgctgcacccatcaactcgtcgtctccattaggtatttctcctaatgctatccttcccctagcccccacccccaacaggctccagtgtgtgatgtttcccttcctgcgtccacgtgttctcattgttcaactcctatttatgagtgacaacatgtggtgtttggttttctgttcctgtgttaatttgctgagaatgatggtttccagcttcatccatgtccctgtaaaagacatgaactcatcctttttatggctgcatagtattccatggtgtataggtgccacattttctttatgcagtctatcattgatgggcgtttgggttggttccaagcctttgctattgtgaacagtgttgcaataaacgtatgtgtgcatgtgtctttatagtagaatgatttataatcctttgggtatatacccagtaacgggattgctgggtcaaatggtatttctggttctaggtccttgaggaatccccacactgtcttccacaatgtttgacctaatttacactcccaccaacagtgtaaaagtgttcctatttctccacaccctctccagcatctgttgtttcctgacttttttaatgattgccattctaactggcgtgagattgtatctcactgtggttttgatatgcatttctctactgaccagtgctgatgagcttttttttcatgtgtctgttggctgcataaatgtcttcttttgcgaagtgtgtgttcatatccttcaccccctttttggtgttttttttttttttttttttttttttttgtaaatttgtttaagttccttgtagattctggatattagctctttgtcagatgaatggattgcaacagttttctcccattctgcaggttgcctgttcactctgatgatagtttcttttgctgtgcagaagctctttagtttaattagatcccatttgtcagttttggcctctgttgccattgcttttgatgttttagtcttgaagtctttgtccatgcctatgtcctgaatggtatcgcctaggttttcttctagggtttttttggttttaggtcttacatttaagtctttaatcgatcttgagttaatttttgtacaaggtgtaaagaaggggtccagtttcagttttctgcatatggctagcaagttttcccaacacaatgtattaaatagggaatcctttccccatttattgtttttgtcaggtttgtcaaagatcagatggttgtagatgtgtggtattatttctgaggcctctgttctgttccatggttctatttatctgttttggtaccagtaccatgctgttttggttactgtagccttgaagtatagtttgaagttaggtagtgtggtgcctccagatttgttctttttgcttaggattgtcttgactatatgggctcttttttggttccataagaaatttaaagtagttttttctaattatgtgaacaaagtgaaaggtagcttgatggggatagcatctataaattaccttgggcagtatggccattttcacactattgattcttcctatccatgagcatggaatgtttttccacttgtttgtttcctgtcttattttgttgagcagtggtttgtagttcttgacgaggtcctttccacttgtttgtttcctctcctatttccttgagcagtggtttgtagttctccttgaagaggtccttcacatccattgtaagttgtattcctaggcactttattctctttgtagcaattgtgaatgagagttcagtcatgatttggctctctattattggtgtataggagtgcttgtaatttttgcacattgattttgtatcctgcgactttgctgaagttgcttatcagcttaaggagattttggactgagacaatagggttttctaaatatatactcgtgtcttctgcaaatagagaccatttgacttcctctcttcctatttgaacactctttatttctttctcttgcctgattgccctggacagaacttccaatactatgttgaataggagtgatgagagagagcattcttgtcttgtgccagttttcaaaaggaatgcttccagcttttgcccattccatatgatattgactgtgggtttgtcatgaatagctctcattattttgagatgcattccaccaatacctagtttattgagagtttttagcatgaaggggtgttgaattttatcaaggccttttctgcatctattgagataatcatgtggtttttgtcgttggttctgtttatgtgatggattacgtttattgatttgcatatgttgaaccagccttgcatcccaggaatgaagccgacttggtcttggtggataagctctttgatgtgttgctggatttggtttcccagtattttattgaggatttttgcattgatgttcatcagagatattgacttgacatttctttttttttgatgtgtctctgccagtttttggtattaggatgatgctgacctcataaaatgagttagggaggagcccttctttttctattgtttggcatagtttcagaaggaatggtaccagctcctctttgtacctctggtacaatttggctgtgaatccgtcttgtcctggactttttttgttggtaatctattaattactgcctcaatttcagaagttgttattggtctactcagggattcgacttcttttttttttcaattttttttttattatactttaagttctagggtacatgtgcacaatgtgcaggtttgttacatatgtatacatgtgctatgttggtgtgctgcacccattaactcgccatttacattaagtatatctcctaatgctatccctccccactcccccaaccccacaacaggccccagtatgtgatgttccccttcctgtgtccaagtgttctcgttgttcaattcccacctatgagtgagaacatgcagagtttggttttctgtcctagcgatagtttgctgagaatgatggtttacagcgtcatccatgtccctacaaatgacatgaactcctccttttttatgactgcatagtattccatggtgtatatatgccacattttcttaatccagtctatcattgatggacatttgggttggctctaagtctttgctattgtgaatagtgccacaataaacataagtgtgcatgtgtctttgtaacagcatgatttataatcctttgggtatatacccagtaatgggatggctggttcaaatggtatttctagctctgatcgccatgctgccctccgcaatggttgaactagtttacagccccaccaacagtataaaagtattcctatttctccaaatcctcaccagcacctgttgcttcctgactttttaatgatcgccattctaactggtgtgagatggtatctcattttggttttgatttgcatttctctgatggccagtgatgatgagcattttgtcatgtgtttgttggctgcataaatgtctttttttgagaagcgtctgttcctatcctttgcccactttttgatggggttgtttgatttttttcttgtaaatttgcttaagttctttgtagattcttgatattagccctttgtcagatgggtagattgcaaaaattttctcccattctgtaggttgcctgttcaatctgatggtagtttcttttgctgtgcagaagctctttagtttaattagatcccatttgtcaattttgacttttgttgccattgcttttggtgttgtagtcatgaagtccttgcccatgcctatgtcctgtatggtattgcctaggttttcttctggggtttttatggttttaggtctaacatttaagtctttaattcatcttgaattaatttttgttctgccctctcttaccactcctattcaacataatgttggaagttctggccagggaaatcaggcaggagaaagaaataaagggtattcaattaggaaaagaggaagtcaaatcgtctctgtttgcagaagacatgattgcatatttagaaaacccaaacacttcagcccaaaatctccttaagctgataagcaacttaagcagtctcaggatacaaaatcaatgtgcaaaaatcacaagcattcctgtacaccagtaacagacagagagccaaatcatgagtgaactcccattcacaattgcttcaaagagaataaaatacctaggaatccaacttacaagggatgtgaagcacctcttcaaggagaactgcaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctactgatgactttcttcacataattggaaaaaactactttaaagttcatatggaaccagaaaagagcccgcattgccaagccaatcctaagtcaaaagaacaaagctggaggcatcacgctacctgacttcaaactatacttcaaggctacagtaaccaaaacagcatggtactggtaccaaaatagagatatagaccaatggaacagaacagagccctcagaaataataccacacatctacaaccatctgatctttgacaaacctgacgaaaacaagaaatggagaaaggattccctgtttaataaatggtgctaggaaaactggctagccatatgtagaaagctgaaatgggattcaacttcttcctagtttagtcttgggagggtgtgtgtgtccaggaatttatccatttcttctagattttctagtttatttgcacagaggtgtttatagtattctctgatggtagtttgtatttctgtgggatcagtgatgatatcctctttatcattttttattgtgtctatttgattcttctctcttttcttctttgttagtctggccagcggtctatctattttgttaatctgtccaaaaaaccagctcctggatttactgattctttgaagggtttttcgtgtctctatctccttcagttacactctgatcttagttatttgttgttttctgctagcatttgaatttgtttgctcctgtttctctagttcttttaattgtgatgttagggtgtcgattttagatccttcctgctttctcctgtgggcatttagtgctataaattttcctctaaacactgttttagccgtgtttcagagattctggtacactgtgtctttgttctaattggtttcaaagaacttatgtacttctgccttaatttcattatttatccagtagccattcaggagcaggttgttcagtttccatgtagttgtggggttttgagtgagtttcttaatcccgagttctaacttgattgcattgtggtctgagagactgtttgttttgatttccattcttttgcgtttactgaggagtgttttatttccaattatgtggtcaattttagaataagtgtgacgtgatgctgagaagaatgtgtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggtctctaagaacttgctttatgaatctgggtgctccagtattgggtgcatatatagttagaatagttagctcttcttgttgcattgatccctttaacattatgtaaagcccttctttgtcttctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacagcacaccgatgggtcttgactctatccaatttgccagtctgtgtcttttaattggggcatttttcccatttacatttaaggttaatattgttatgtgtgcatttgatcctgtcataatgatgctagctggttattttgcccattagttgatgcagtttcttcatagtttcaatggtcttcacaatttgatatgtttttgtagtgactggtactggtttttccttttcatatttagtgcttccttcaggagctcttgtagggcaggcctagtggtgacaaaatctctcagcatttgcttttctgtaatgaattttatttctcctttgcttatgaagcttagattgactgaatatgaaattctgggttgaaaattcttttaagaatgttgaatattgggccccactctttactggcttgtagagtttctgcagagagatgcactgttgatctgatgggcttctctttttgggtaatccgacctttctctctggctgccctcaacattttttccttcatttcagccttggtgaatctgacgattatgtgtattgagtttgcttttctcaaggagtacctttgtggtgttctctgtgtttcctgaatttgaatgttgacctgtcttgccaggttggggaagttctcctgggtaatatcctgaagagtgtttcccaacttggttccattctccccttcacttttaggtacacgaatcaaacgtacgtttggtcttttcacgtagtcccatatttcttagagtctgttcatttcttttcattcttttttctctaatcttgccttcacactttatttcattaagttgatcttcaatctctgatatcgtttcttccacttgattgatttggctattgatacttgtgaccaatctttttttgttttcttaaagcgttgagaaagcgattctttcatccagttttccattttattttatgaaggaagtttgtcaggttttactgacaattaacatagtactaatcaaaattataattattgcaactttatatgttataatttgatattataaaatattaagtatattaacagcttttcaatgcatgaaatcaatctgcagacatatatattttcaaacggataaaccatgcaggtaaaatgaaatgtgatccactttttttttcatgtctaaccttatttctttcctttatcttaaagggaaacctctcacaactatttcttatctattttgtcacagatttcccttctttgattcatgcttccacctactgcaatacggtttatagtgattaattctaccaatgcagctctcactaagatctccactgccatttatttttctgatgtagtggacagttttaatccatatttcccccaagtctattgattcttcttctaaatacatttattttcaagacacacatttatcaccattaagtctttccttcactaatgtacagttttccacccttgcttcctttgtgtctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttttcattccttcctccttaatctttcctgcaagttcgttcataaagagaaggatctcatgatttctgctctgacagcctcccaggaacaagggctatacttcttctttgtcagataaagagtgattctttgaaagtattttctcacagccaggatggagtccacattcctcaggggagtctcttccactccaaccttctacatcacacaggcttccaggtcattcagctgctggtaaagttcagtgtagaatttgtctaaaagggtcgcatcccaagtatcagatgagtcctttgtgctgaagaggttgaaggtctgctgcatcatctcatggaaaaggaagatagcttgaaccttctggaagtggttgccatgaaacacctgatgatggaaaatcaaagtcatgtctgtccttcaagtaagaaaaaggagagattctcctcatttgtgtcaggagtatgaaggccctcctgttacccacgctgtgggcctgaggcagatcacagcccagaggcagatggacttgcagctgagcaccatcatagccatcagtaaactaaagggcaagtccattggggatgtttcagatgctactgggctggctgagagagtgactctgaactctggattttaggttatctgaagaccttattttgtacgtaaccttaaatagggaacacactagtttctattttctgaatgccccctctcttattttctatttctgtttttgttttcctttatgctctctctacagggctgtagagcagtttcttaactacttctttttcattattacctcctcttctccttccccatagtctttttagaaatgtctctgtaattcaaattcccactaatatttaataacatagatatactatatatctgctgatgttctatgcacacatctctatatataagcagtataaagtttaatgtttttattcaatggagggttaagaatgactaaacattttaagctaaaagttaatagttaaatttaaaacccatgaatatttaacttaactccatatctaaattttaaagtgatttttatataatttattcacttatataaattgtaatgtgtcaaattacatgaccaaattaacaagttataaaaacaaataataatacctaatataataaaatacttaaaagtcattcaaacctgctaaagacttaaaatttaaattattttttaacattaactgttagtgcacttaacttttaattttgcttcatggggaaaacttttgacttcagtagctgctagatattcatccagatattgtcaagattgttctcttttcagtgctgagacaattaatgatgtgttgaacaatatcagtataattaaataatataatataaagtatttttaattctcaaagcccacaacacgttcagaattgctaaggatcagacataagcaacatccacgagatggcaaatgacagcacatatgtatgcagtggacacctctcatgatatgacttagtcatctagtaaaccttgaaatgtcctctactcacagcacccatttgccataggtttgcagcactgatcttatataccttttgtgtatcttccatggactcaatgtcaatgcttctcatgtgatacacaagaatactcaattaaaaaatgctaagggataagttttttttcagatagagttgagctttaaagggccacaaaccattgaaataggtaagatttgttcctgctcccaagaattaacttattgttcctttgagagcaatatcatacccaatgagactacacaattgagaaaaaatcagttggattaaaaaaatttgtacattaaaattcaaatttccaaagaacctgcaaaggttccaatactagttgattcttatctaactaaatgaaacaatttttgtcctaaatgttcatgatgggaggtaaatgtgataacatatatgggctgtacaattgttttacatgccatgccagacaccagagatatttgtttctaattttcattttcattgaaaacaaaagttgttacttttgcatcctaaagaatggagacaagaagaaaacaaacgtgtatctaaatgtgattaaaatgttaaaaggaaaaaatatcttaatggaaaaaaataatgatgaaatagaatttacctacattaattccagtcacgatggaaattaaaggaaggggaagagcagaagcaaaattgtggaagagatgtagatcaaagggagcaaatgagcatgggctggaagaatagtaatcattcctggtcaggggtgtgttttcagctttgctgaatccagccttcacagagagtcatgggacacacaccaaccacaagagtttatacataaaaaaggcaaaaatttgagagtacaatatactctctgcataataggtaagtgatgatgtaccaagttctcccttagtgtataaataaactcaagagatcaatatttttcttatcacatctcttacaagaaacaagggaattgataatgtcaaaggacactttctgcaacctagtaaagttcgataataaaaatagtgattaaaaggaaccaaatacctaaattgttgaatgtgtttatttttagtcagacattgttcttagcacttacaaaattgatgctccctttaccaataatgaatactcttatttttcatattaactgaacacctaccatgtgtctacccccattaattcactggagatatcagtgaccaaagaagactgataggttctactgttattcctatttacaaaataaaaaatagaagtataaggaactatcaaattatgaagccattgtttgaacccaaaatctgactgagccctcagttcttacatgctcccaggaatatttctggtcataagaactagagcgatttctagattgatcaatattttcccagtagagtcctgcctaggtaatgacagagtctttctcttcagctgtttactagtcttcttcactgaaattccccatttgatcatgccaacatgttacattacaattaaattgggtcccattttgcttacacattatattctagttttgtttccttgagattatattttatatgcttgaatgtatttgtcaaacacttggttcattgcagtaaatatattcataagcaattgtttgaaaccctacatatttctactcagttattcaaatatccatagtgctttagatttctacctgtttagtgcaatcctaattaagactaagtcatgatcaggatattgaaatgagctaaattagaactaaaccaaggtaaggtgcagagttcagggaaggctcatctggaagggctctctaaggagattaaaggtgtggaaatagaaacacttctggggaaatggggaagtccagtgcattagaggaggaggactgagatgacaaaagattctgaatcacctgacttttcagctggttgatgccttttatgttgtaggtcagctgagtttgctgctgtgttgattgcgctgacttactttgaggaactggtaaacaaaaacattatgctgacacttggtattacggtaaggaagacttaatttaggactcttgcaacagatgccaaaactatcacaataggggagagagatcaatctgaactcaattctgaatataacaaagacagccttggatttgtagccaacaagcagaatgagaaagtctatggatagaaaatcactaagaaaatccttgctaaatcaacttaacagaatttttgccaaagtaaagccagggcagtcagatatctagggtacaggaattctcataaaactgacttaggaagattcttgctacatctggaccaggcagaactaagagtggactccaagacatggtctattcaaaaagagagctcagaggagcctgactaacatttggtgaagaagagagcctttcagaaccctaaagggataaagagtaagagacagaactatcttctaaacacttaaaatggcatatgaaattttacatcttttatggaaaaatgggaatttaatgatgatttcaattaatgaaatacactagtaaaaatttaaatcatctgtataagaattttggactttttaacttttattttgaaacaattttagatatgcagagttgtaaatgtagtacagagagtcctctattcccttcactcacttctcctaaggttaacagcttacatagccatggcacaactatcaaaactaagaaatcaagattggtgtactaaccctaattaaacttcagacttcactcagatttcctcaattttttattgatgtctttttcctattcaaggaatctctccaggatcccatattgcatttcattgtcatttctctttattcttctctaatctgccatacacgctcagtctttcctgactttcatgaccttgaaactttttaaagaatattagtcaattatttttgtagaatgcccatcaatttggatgtgagtgcattttctcattattatattaaaattatagatgtaaaagatgaatacaatagagtgaatcttgtcacatcaagtgatataggagatatatatcaatatgttgccttattactgctgatattaaacttattcacttggtaaagtttggatatgcctgttttctccaatacaaagttgctatttttcctttccatactctttatattggtaacacgtcactaatgtgagcttacactcaaaaggagggaaattaagctccaccccatggaaagagaagtatcaaagactttgttgacatgtgttaaagcttcacagtaatttaaaaatcttttggagggagatacattgaggatatgcagttatcctcattctcttcaaggctttgcttattgattttatgattcaacagtagatcttgcctgttgcaattatatttatgatgttctgactatgatattctattttcctcgttccttgtacatttattatttgaaatgcttttgaaagatggagttggcctcccttcccaataaatgtatttatttactcattacttatattagtataaactcatggatatttattccattctttatgtgataataaaatactatcattatctattgtgttactctagttgtcccagctttggctattggaagctcattaaggctggcttctgtgtccttttgacatgtacctatacattttgtttttgcatacttcttcatcttctggcaccacaagatactccagtatccttgtatttccatgacacagaccaagaatcagtcatttctccaagatgtattaatgccttttattggagattggtattttagaagacaagatctgagagctacatgtgcttagcagtactaggatgtcactgcttttaggtcctctcagtgacagagataggaatataagtagtacatatacgtatactaattttttatatacacatacctatatttatttctgtccacacctatatctaagtaaagactaaagcaaacatgagactatacaaatatctttgattctaatccagcacaataaggttaattctagcctttccattttcattatttgaaacttctttttccaactctgagatacttggtttttgttagtaacaatatttttacctatttactcaagtctaataatacacataatgtttcggaactactaactagaatttctgtgagaaacaattctaccaactagcatacagtgtttgtgtacaacccttttgtgtttcaccttaaagtatctagtcaccacatggctagacagagtatttgtcactttcagagtggttatgtcatacatcaattacattaatttgtcatcatctagattcaatcctggtatctactgccaatgtggttgagtttttaaaaatttacatacagtaaaattcacaccttttggtgcatagttccacaggttttaacaaatggacagaattatagttcatttatttttac

SEQ ID NO: 461 - DNA, 78252 bp, Homo sapiens
acttgccttaaattctggaaaattactaagaattaagcatcaatatgcacagttctcattttcactactttcttcttctgtaattcttattattccaacatacacatgggatcttttcattctctcattttatgtgctatgttgcttaacttctcatatgtttttccctttttgttggtgctgcatcctttataatttcttcagatttatctttcaaagtactgattctttcttcagcttcatctgatcttctgtttaaattaactgagttttattttcaatgactgtatttttatttctattagttctatataattatttccaagcatgccttcttttgtctacttttaattcaatacacttcttaaacatatttattttattatatctttcaaattgttctattatttcagtaattgtcagggtgccatttctcctatttgctacatcaacagacactctatggtaatttgtttcttcttgggctttgaattgctgctgcaattgaacttatctttgaatattaaaaacactctgtgaaacaaattaccatttaatatttttgctttcataaaatagaatagtaaacaccagtgaaaaatagatgaactaaagctacatgcatcaatgtaaggagtcatataaaataatgtttataaaattcttggttaagaaatacatatagcatgatataaattttagaagtttaaaatatataatcaatgctacatattattttggattacatattcctatggtgaaaatttaaatatgtacaaaagaatgataaatatccaaatcagtagttacttatgagagaaagaagcagaaggagatccagcatgaatacaaatgagaatacaaattttgtaattgcttgtaatcttcagagtatattaacattcaatatagtgttctccacacatttctgtagattaatacataaaggcagtaaagtcattgagtagcctctcttccaaatataaaacaataaaaagataatcattaaagcaagtcttgtattaatattttaaactttaaatagattactaaaataaaactagaatatctgaaataggcccatctcttagaatttagtataataaaaccagagactgccacagaaaactaggcaaataatctaataattcacagaactataaatggccttgtatccatcaatctctctgtgaaatattttctacttatataaagtatgtatatttattattacctacatatatatacgtctatatctaaagatatataaagttagaaaaaaggaaaccaaactattattgaaatagtttaatagaggtagggttttaggtgatttaaaatttccagtgttctaaaataacaatattttaaaattatgttctgcttttatccaaattatatgctcatgcttaaaaagttatataattcagtggttgtacacaaaagccacagactactcttattacatactttttcctgcttctcagaggcaaccactttcaaatagtttgcatgattctatttttatttatatgcaaatttctctgcaatatgattatattgctacttcttaatttatttggatggggaagggatgatttagacactgtatattgacattctattttggaagatacaaatcaagcctttttcaacaccactttggcagaccttgctctctgacacacgtgtgtcctcagcctctcatcattatgtcatatcatggtttggttgcatatgcaatttttacattgccatattgatataagcactatttacaggatacacatgtcagacattacttctactcttccttttataaaaatattaatcctttttattttttcagtttattgtacgatttttaaattgtgtggttttgttgccattgctttctgtgttttagtaataatcgctaactgtcatttaatcctttgcccccatatcccatatatcacttttgttaatacatgtaaatatacaagaaattataaatttaccttgttaaatcaagccctcctgataaatctcatcctgctgcaaattaccctgggtgtttctccagacctgcctacagctgtcaccttgtgatgggtgattccctctacctttcttctagattggatgccctattccctagatttcttgtcctctttcttggtttaccagctaaaacatcttccagtaacattaagaaaataactgcacgggagataaaagtcttaaatactttgttgcatacttagccatagaaccctagattataactcatactgtctcatcagaatcacgaacacttggtcttattgtttactagcttatttcatattaatgttccctccaaaagcttaaatatttcctttctttgtatccagggtactgacttttcaatgatgtgtcttaagatggatctattgctattcataggactgggaacatggtcacatggtgagtctattcattataaaagcatatgtctttccattctgggaactttttatgatttttttttttcatgaattcctatgctatattttctgttttctccttccgggatttctatgttttaagacgttggattttctctgtgggttccctaattttattttattttatttctattcttattttttcctaatttcaatcttagacattttgcttttcattctggaacagcttttcaactttaccccctaaaactttcattgtatttttccatttacactatcttagtttccaacattaaaaaaaaaaaaatctgtgttcttgttttcgagatgaagaaccttttctcacatctttgaggatattaatcccagatattttgaagctttcttttggtgaaaacttttctccgagttattgtttgtttgttttagtctctttggtataacatgctttcttcaaatatctaataatccttgggattctgctataaaagcagagcacctctcctcctccaaaggaacgcagctcctcaccagcaacggaacaaagctggatggagaatgactttgacaagctgagagaagaaggcttcagacgatcaaattactctgagctaagggaggacattcaaaccaaagacaaagaagttgaaaactttgaaaaaaatgtagaagaatgtgtaactagaataaccaatacagagaagtgcttaaaggagctgatggagctgaaaaccaaggctcgagaactacgtgaagaatgcagaagcctcaggagccgatgtgatcaattggaagaaagggtatcagcaatggaagatgaaatgaatgaaatgaagtgagaagggaagtttagagaaaaaagaataaaaagaaacgagcaaagtctccaagaaatatgggactatgtgaaaagaccaaatctacgtctgattggtgtacctggaagtgatggggagaatggaaccaagttggaaaacactctgcaggatattatccaggagaacttcctcaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagactgggggccgatattcaacattcttgaagaaaagaattttcgacccagaatttcatatccagccaaactaagcttcataagtgaaggagaaataaaatactttacagacaagcaaatgctgagagattttgtcaccaccaggcctgccctaaaagagctgctgaaggaagcgctaaacttagaaaggaacaactggtaccagccgctgcaaaagcatgccaaaatgtaaagaacatcgagactaggaagaaactgcatcaactaacgagcaaaatcaccagctaacatcataatgacaggatcaaattcacacataaccatattaactttaaacgtaaatggactaaatgctccaattaaaagacacagactggcaaattggatcaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaactgactttaaaccaacaaagatcaaaagagacaaagaaggccattacataatggtagagggatcaattcaacaagaagagctaactatcctaaatatatatgcacccaatacaggagcacccagactcataaagcaagtcctgagtgacctacaaagagacttagactcccacacattaataatgggagactctaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaacaatctctcagaccacagtgcaaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcccacaagagaaagcaggaaggatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaatagagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagcagttgaatctctgaatagaccaataacaggatctgaaattgtggcaataatcaatagcttaccaaccaataagagtccaggaccagatggattcacagccgacttctaccagaggtacaaggaggaactggtaccattccttctgaaactattccaatcaatagaaaaagagggaatcctccctaactcattttatgaggccagcatcattctgataccaaagccgggccgagacacaaccaaaaaagcgaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatataagcaaatcaataaatgtaatccagcatataaacagaaccaaagacaaaaaccacgattatctcaatagatgcagaaaaggcctttgacaaaattcaacagcccttcatgctaaaaactctcaataaattaggtattgatgggacatatttcaaaataatatgagctatctatgacaaaccgacagccaatatcatactgaatgggcaaaaactggaagcattccctctgaaaatgggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaattcacaagcattcttatacaccaacaacagacaaacagagagccaaatcattagtgaactcccactcacaattgcttcaaagagaataaaatacctaggaatccaacttacaagggatgtgaaggacctcttcaaagagaacgacaaaccactgctcaacgacataaaagaggatacaaacaaatggaagaatattccatgctcatgggtaggaagaatcaatatcgtgaaaatggccatactgcctaaggtcatttacagattcaatgccatccccatcaagctaccaatgactttcttcacagaattggaaaaaactactttaaagttcatatggaaccaaaaaagagcccgcatctccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgaaaaacctgagaaaaacaagcaatggggaaaggattgcctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaagacaaaattgacaaatgggatctaattaaactgaagagcttctgcacagcaaaagaaattaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaaagaagacatttatgcagccaacagacacatgaaaaaatgctcatcatcactggccatcagagaaatgcaaatcaaaaccacaatgagataccatctcacaccagttagaatggcgatcattaaaaagtcagaaaacgacaggtgctggagaggatgtggagaaataggaacacttttacactgttggtgcgactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaaaatgatagactggattaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccacgtattctcactcatatgtgggaattgaacaatgagatcacatggacacaggaaggggaacatcacactctggggactgtggtggggtggggggaggggggagggatagcattgggagatatacctaatgctagatgacgagttagtgggtgcagcacaccagcatggcacatgtatatgtatgtaactaagctgcacaatgtgcacatgtaccctaaaacttaaagtataataaaaataaaaatagaataaaaccaaaaaaaaaaaacaatgggtctgttgaacccatttttcactatgatctagctgatttcgttctacttaagggttttctgctgccatttttgttaggtcttttctcttgagtaagacatattccctacagaagattcatacattttcctgctcggatgaaacttggctgcctgggttctgctgtagatctcaataagaggggagagtcaggcagggtgaagtgtttcagcgtttagtatgcatattcctcctttcagttttgtattcctatcctgtgtccacgtgtcctccaggccagagaacctgttttatcctctttggggaataaagttcttcttttctagtagggggagtgaagagtagtagccttattttgaagaacaggaaaagcaacacagaagtctaactgttcaagagactccaaactacttttatggtatttagccataatttcatctcttttggcaaaagtccctggtgggacaaatcttaaattttacaaaagagtatcgtaatgaacactggggggctttttaactttctgcactgtcattttagcagaaagaaagaaagaaaaaagctgaatcttacttacctagtttccagcttcaaaaatgtttcatttgtgatctttcaattttgcttttgagctcgtgtgtgtgtttaattactcttactggtctattgcatccttagaagtggtattcccaaaaaaagaatctatataaataaaaacctatttgatgatgatttgaataggaaaccatgccccaaataaagagatttagagaaaaaagtagtatatttgccaaatctcttaagtaaccatgctttggtttcttatttattgaaagaaaagttcaggtccactattaaatataagaattgataataatgactaggatgtttacttcttcaggatgcatatacattcaatttgcaatcaaataaattctaaaaactgtcatcaagtaaatattcagacactgtcagcactttattggaagagttgtgagtatttgatcttgcagattactaatactctccagagagggacttttcatgttttcagttttcaatttacaactgtgggtcaaagtcaacaccttttgtgtcttcatctgaaaatgtctcagatctttattctgaaatgtcttcaaattgctgcttgagaatatatgtcccatttcacccaggagaatgtttccctctgttagaaacaatgcattttgttttgtctctctccagtggcctcatgtatagaatttcaaacataataggtcattgcacatgcattttattgcctgtaagtcttacagcttgtagtatgctcttccaacctcaggttccaagatcctacagtacatggccactgacggcctttggtatatgactgtgtaataatggaatctattttcttgaccaaacactgtgtaatagcttttattattttctttcaacccatgtaacttacataagaaatacaatcaaaattctctttttttcacaagttacaaagtttttatgtcagtcttgtgtccttttctccatttttctgttaaattttttttgttctgtacaagattgtccttttatgtttgccagtatttaagttgtttgggggaaatatttatatctccaggatgtttttcatttcaagaaaagtttagtgtacctcaactggatctgaggctggaatctaggaaaaacagagaataatccagggacttactttcaccagcttaaaaatactataaaatcatcctctctattctccaacatctgtacatagagtagaggaacagcaaggagcactgggaaaagcctgtgtagccacatgcagcctcctactcaaagctgcctttggtcttcttctctgtatctcccaagttaagcagcttatatttaggaggaaaaaaaaaaaaaaaagaaaaatgaaagatgatctgctcaccactgattacgttaccaatacttctcatcttttgggtactgtgaggattaatagtatgtatctgtatagctggcccacattgcccagataatctggctaagcattattctggatgtttctgaaagggtgattttgggtaagattacatttaaatcagcagatttgggtaaagtaagttgctccccataatgtgggtgtgcctcatctaatcagttgaaggattaggaaaaatctggtcttgatctttctgaacaagagaaattcttcaggctatcagccttcagacttgaactttagcattagctctttcttgggtctccagcctgccaacccactttgcacattttaaacatgtcagcctctataactgaataaggcaatccttaagtcatcttctatatacgtatacacatcctattgattgtcttttttctaaagaattatgactaatataaagactagcaggcattatttgggtgtgattatatatatatttgagtctttatgccacactgtttggcgtttttattttttacaattttatttatttatatatttttttgagacagggtctcactctgtcacccaggttggagtgcattggtgcaatcttggctcactgcatcttccacctccccagctcaagcgatcctctcacctcaacctcccaagtagctggaaccacaggtgcacaccaccatgcttggctaatttgtgtgtgtgtgtgtttttggtagagatggggtttctccaagttgctcaggctggtctcgaactcctgagctcaagtgatccacctgctatggcttcccaaagtgccgggattacaggtataagccaccacacctggcctcattcttcttcttaaacatataagttttgtgtaaaatacacaacgaagaggacacagtattgtgtttttccaaacaaaattgccagctcttctgttgaaattaaagtggcaagtgaggaaagaaggagggaggagtacatgatacgatacttatcagtacccttatgtttttgtaactcctaccactaattttctcttaccatatgcactctgccacactccttatttcccaggctccctttagaatgcccaaccaccctatagaaaatgagtacgaactctgaagacatcattggatagagttaccgttaaaaaaaattcactcaatgttattcagagtcattttcaaagaaacagctctggccactaggagatacgaacctgagtatcatagggaatctgtggattaaaacagattacttatagtagtaagcaaaataaagtgtaggagaacctctgatagttactttttaaatttacctcaggagatttgtccctgtttctataattagtttataaagaaccttatatttattttaaatattttatatctatgctacttatacatcagtaattggtttaatagatttatatataatataatgtgtttatatattatatataaatgtattatatatgtataatatatataaattatatataaatgtattatatatgtataatatatataaattatatataaatgtattatatatgtataatatatataaattatatataaatgtattatatataattttgtgtgtgtgtgtgtatatatatatatatatatatatatatatataaaaaatatgctactagaactgaaaaagacagtagagaaggctgaaggatttaagcttcacactcctacagacatacctttacacagtgaggatgaagcactgcacacagatctgtggtgtaccaatatgcacttaatgagcactccagctctctgcttttcaatttgtactcgctgaacttctattttttaaactgaaaacaaacaaaaacactgtcatccttttttcttgatgtatctgcaatagccactttgaactcctctggtaccttatcaaataaccccatacagtgggcagtctgcagagattgcagggaactacaagaagggtccacataatatggtgtgttacagttactaaaaatgctctgctaatgaaccaagctaagatgattggtctcctcgttcatagaacttttcagtttttcaggaaatagaaggtctacttttttctgaagaattacaagtaaggaacgatgattattagagattagaaagcattgttctttttttcctctattggtgaattattctcagtgagctaaggctttcctgaccgccagtttcacaactctcccacataaccatctctaatctctcatgtataaagtcaaaatgaatgttttccaagaattcaatattcttcaacaggaaataagcaatgtgcatttactttcaaaaaaaaaaaaaaaaaacagaaaaaacaaaaaattggtccccattaagcaaatttcaccaggaaagtatatgtttccttcacagagttataggaaaataaatttctacaaagctttcctgtgtcatgctaaaagggttagtgatgaggatataaggtttacaatgttaaagctgcaaaggaatgtgtctttatgatgaggtgagcctctttctgatgttgtaaaggtggttgaaatacctcactctcccatttttctgacagattttatattttaaaagctttggacaggatagacacaaatagcttttactgcattttacatatagttaccacatttaatcattacaaaaactgtttgaataaaacttatttatttatttgtgtatttatttatttatttattttgggatggagtctctctctgtcacccaggctgcagtgcagtggcacaatctcggctcactgcaaactccatctcccgggttcaagcgattatcctgcctcagcctcccaagtagtggggacaacaggcgcatgcgaccacgccctgctaatttttgtatttttagtagagatggggtttcaccatgttggccgggctggtctcaaattcctgacctcaagtgatccacccaccttggcctcccaaagtgctggaattataggcctgaaccacatgcctggcctgaataaaacttgttattttcattttatagatgagggaactaactttcagtgaggttaaatattttgatcaaaacctcagaactaataaagggaagagccaggaattaaatccagatctatcactgtctacttttttatactatctcctctctgggaatatcaataaattaaaatcgggtacttacagaattctcaattgtaacgacaaatctagaatatcagggtttctgtacttagtgaccagaagtcatacagctttctatttacgtctaagttcaaaacatattctggacaataaaagaataatcctctctaaagacaaattttggcaaggaaaaatgcagtccaatttgcttgcattataaaaatagaaacacatgtaatctcaaattaactgtctttgttttctgcagttctatgcaaatgcaaatatgcaaaagaacaaatgcttgatagaaaaaaatgtacatgttggcagttcattatccttgtgtttttcttaattgatgagtgctttctctgttgaaactcttaagatcgctcagattccctggcataagtcctcatgaaaaatcatctaaatgatatctttgtggagactatgatgctcaatcagacattttggctaacatactaggctgctgatctgacattcagtgcccagaatcgcggctgctgagccaagtaaaccacctcctgagttgtttctggtccaatctgtggtatctctgccaacgggttttctagatagttagacccctcctacctatgcataacaatgagctagcatgctagcaaagtcccaatttttataaatgtagtgatgcatcctacagatacataaagtcactgataatcagaccaatgtctgcacatacgtgtttaaatcaattacaatgacaaatagatgctttatgagaccatgactattcagaaccttattttagacacttaacacattggtaaccatcacagaaacaatgaaaaagaattgtggggaaaagtaaaataacaaaataattatcttttgctgatttaatatcatatggaacaatagtcttttacatagaaagaaaatatgattatattattgaagcatcctgcactttcaaaatgtaatcaatcattataggtagtctcctaagattagagtcatacataagaaatcataaggaaatctagatctgcaaaagtagatgaaccgggagtagataattctaaataaaccaattgtgcttttttaaaataaataatccagtttacttgagtcacttcaccagacttacaggcaccaaccctacctctatcttagattacagttacaactaaccaagttcttgtctcctcaacctcctccaatttgcctttcatacagcaagcagaggaatctactaagagcactgttgtagttgcgttactaccctgccttaaagcatttatgctcctcctcctttcaccactgctgtcacacatgctgtatgcccaaattctttatcttgaatcttagggctccaatgtgcttttcaagaattttcttttctctgtttataacattagacctatgcttgcaccaataaacctgcactgtttaatgcaattgttaccggcgatgtgtgtcactttacacttaaatcagataaaattaaaaattcagttcctctactgcactagccacatttcgagtcttcaatagtcacttgtgactagtggctacggtattggacagtgccgattatacatcattgcagagttctatggcacagcactgctgcatacctgccctgaggttctatggtatgaagctgtctgcaagttctgatacatgttattcccttaaagtagaaatgctcttgcttcctgtacacccctccaaatttacaaactgaaattccatcacccttcaaagtgtaggctacttttcatattttctattccctccacccgtatatattccatttagaaatgatctccaacacttctgaaatttttttgagtttaatttataatattcacatgtaaaatctcatactgctgctttaaactatcaaaaaataggaatatatataagtctcactctgtcgcccaggctggagtgcagtggcgccatctcagctcattacaagctccgcctcctgggttcatgccattctcctgcctcagcctcccaagtagctgggactacaggcgcctgccaccacgcccgggtaattttttgtactttttagtagagacggggtttcaccatgttagccaggatgatctcgatctgacctcgtgatacccctgcctcagcctcccaaagtgctgggattgtaggcgtgaggcatcatgcctgataaggaaaaattatttttatttttttttttttacagacatctagagacagagagaaggagagatctaggcaaaagaattatttttttgagacggagtctcgctctgtcgcccaggctggagtgcagtgtcgcgatctctgctcactgcaagctctgccttccgggttcatgccattctcctgcctcagcctcctgagtagctgggactacaggcgcccaccaccacgcccacctaattttttttgtattttttagtagagacggggtttcaccatgttagccaggatggtctcgatctcctgacctcgtgatccacccgcctcggcctcccaaagtgctgggattacaggcgtgagccactgtgacgagcccaaaaggattattttcttgctaacttggggaaaggtgaaaggctatatagctttgtcttctcagacactcttggggctttacactcaatagctgtatatctatatatctatatctgtatattaaaaatatgaacatataatccaccattttgtgaaactttttttcatttaccaggagaaaactgaggaccagcgaagtggcctgcagaagtaacaaactccttaacaagtgctatggcaccagctcatcagaatggacactggctttaatggtattaactgagtcctaaaggccctcttctccttatttcctgaatattgggaagatccaaaggtttctgcaacaaaggggacaaccaagtaaatggtggaggaggatcttttaggggctcgtggctgaagccactttgtctaccagaatggcaccatttcaatattttgtcaatgaatatagctacacctatgcttattaaacaagtctggtgacataattgtcccaagttcatacagtcagtagaatttgccatcaaacaactttaaaacaacttttcaggaatataactactatgccacatgaaatacccaccttctgggatattgaagcaaaagcttttcaactgctaaataggcacatgatctttataccattggtataatgtcacgtacatttgtgtgcagattaccacatccctgaaaactgctccctcagatgttgtgtatggggtaattgatgctttaggcctaaaaatctaaataagctgacacttttattttcagaagtgcctgcaaggggtgcaattcaaaaaaattacatttcaacctggctgattggctaataaaatgaaagtagtttgtaacaaataaacaagtaaaggatatggcatgctttgcactgcttttaacataaatgagtaaaatcacatcatttctttcaataaaaacatcttgtgcctaaaataaaatgcctgatgttgatactgaaatggtatgctttcatctaaaatatttttgatagctcgttgttgccaacacttaaaacaaaaagttgctaacttctttaaagtggccaactacagtagtgcaaaaccaatagttgatatgatattatttttagccttcatcttcagctttaagtaatgttcagtaaatgcaacattacttccttattgatatttatccatgactccacacagaaaacaataaacaaataaaccttattcataaggctgtctatataccagtggtcattttatagtcagaatttttttgcatttaaaaaggcagctattatgttggtgaggatgcagagaaaagggaatgcttatacactgctggtggcaatgcaaattagttcaacttctgtggaaaacagtagaaaatttctcaaagaattaaaaatagaactaactaccatttgacccagcaataccaccattggctatttacccaaaggaaaagaaattgttttatcaaaaagacacctagcactcaatatgtttatcatagcactagtcacattagcaaaggcacagaatcaacctaagggtccatcaacagtgggctggattaaacaaaaagtggtacatatacactgtgaaataatatgcagccatagaaaaaaacaaaatcatgccttttgcagtaacatggatggagctacagatcattatcctaagtgaaataactcagaaacaggcaatcaaatattacatgctcttacttataagtggaagttaagcaatgtgtacacatggacataaagatgtaaataatagacactggggactccaaaagtgaagaggatgggagagaggcaagggttgaaaaactaccttttcggtactatgttcctatttgggtgacgggttcattagaagcacaaacctcagcattatacaatatacttatggaacgaacctgcacatgtacttcctgaatctaaaataaataaataaataaataaataaataaatttataaggagctgttaaatacttctagattcaaagcatggaaggcttttctttcctcttccctcctcatgcagttcttactctgactctactcactgctattttacagtcagttcgaacaagcaaagctgacttcccatcccacaaaataaaagattcagcaaatcaccagggagtgagaaattcctatagaccagccagtgaaaacaaatagcagggaactgaagtaggtgtgacatcagcaaggtggcagaataagagttttctactctcatctccccacagtgaacaaattctgataaccacccatggatgacagtacctttgtggaagtgtgggagtcaggtggagaagttctagtttgccactggagcaaaaaaatctgaaaacagacaaagagaaaaaaacaaataccatatgttctcacttacaagtgggagctcactgatgagaacacatggattctgggagaggaacaacagacacgggggtctacttgtgggtagagggtggggtgagggagaggatgagaaaaaacaactatttggtactaggcttagtacctggatgacaatctaacctgtacaacaaaccccatgacactagtttacctatattataacaatcccacacatgtattgctgaacctaaaagaaagaaacattttttgaaagttcccaaacagtttcaacccaaagggaacttcaccaagacactttataatgaaattgtcaaaaatcaaagacaagagaattttaaaagcagcaagagaaaaaagacttgtcacatataagaaacatgccataaaattatcagcagattaataacagaaaccttgcaggtcaggagagtgtggaaatatatattgaaaatgctgaaagaaaaaataaaaacttcctctgaaggatgctttatcagacaaactgtccttcagaaataaagatggataaaaacttacctagataaactaaatttgaacgagttcatcaaaactagatctgccttggaaaaaatgctagactgttcttcaacttaaaatgaaggatgctaattagtaatataataacagaggaaagtataaaactcacgagtaaaggttggtatatattaaaattcagaatactcaacactcccaataaaaagtgggcaaaggactgtaatagaaattttttcaatgaatacatataaaggcaacaagtgtatgaaaacattctaagtattgcttatcatcaggtaaatgcaaatcaaaccgcaatgagatatcacctcccatctattagaatggctattatcagaaagatgaaaaataacaagagtgtttatgtaaatgtactgaaaaagtaaactttgtacactgttggtgggaaagtaaattagtactgccattatagaaaacagtatggaggttcctgaaaaaattaaaaatacacttccgtatgatccagcaatcccacttctgggtatacagccaaaggaaatgaaatcagtatcttgaagagatagttgtactctcctgttcattgtagtgtgattcgtaacagccaagatctagaaataacataaattcctagacataaacaaatggataaagaaaaggtgatatatatatgatggaatattattcagccttcaacaatagggaaattccttcattagtgacaacatagatgacctagaggacattttgtttaacagagaagccagacacagaaagacaaatattgtatatcacttatgcatgaaacttgaaaaagtcaaaatcatagaaacagagtataatgatggttaccaggggctggggggtagaacaaatggggggatattggtcaaagggtacaaactttcagttacgaaatgaataatttcaggagatctaacatacagcatggttactatagttaacaatatctatgataattgtataaataaaatttattaagagtatatctactatctgaagtattctcaccagacaaaaaaggtaactatgtgaggtaacagctaagtcaataagcttgattgtggtaatcatttcacaatatatgcatgtatttaataatcaacattgtataccttaaatatttataatttttatttggcaaaaaataaagctggaaaaaagacataaatacaataataaacataaaattgaagtagtgatcaacattttcaaacaataaagaaaatagaaaacagcagtgatagttaataaactgacgggaagggtgaagattaaccaagggaaggctacatattcagagaaaacaaatatttttaaaacagacatatgtggccaaaaaattctaaatattttgatagttcctgtgggcatcactgacatatagtacaacataatgatagatacaatgtcatataataattgacattacttacttaccatttctcataactgaacaaacaggaaatggtttagataatttctaccacgtcacggctattatgaaagtttgtctatatgacatgttaacatttgtttttctcaaatatattaataaagaattggacattgcaacccatacattagtattaaatagagctacagtatgagaaagaacaaagcattcaggaacaaagatggattaaaaaaattaaaggagagttttcttctcctttatctgtctatgcgataaaaaaattttacttgggggaaatttattttggtattttaaattttctttctggatatttgtttgttagttttcaagtactatcagaagcatataacttttaagaataaagccaaggtcactgaaacagtttgcaaaaaaaaaaacaccgtgtgattgactatctacttggggagcagcatctgtttttgttgtgggaattctctgccttgcacataactacaaaactctatctactacccatgtcttttttggatttagcattaacaattggtcaaacagtagaacaaaaattttaaaacactcttcagttgtttttcaccccataaatccagactttcttctctattgtgctatttctcagaaaggttgcataggttacttctaagtagacatgcattgtattcactatcaagtagcctacaatgtgcttaaaaacatccacacttttaaattgtaacaacaaatcaagaaaaaacttctactgatattcaactgaaaaaaaaagaataagaaaaataaatttaaaatgagaaagtaaacaggaaaaaattacagattcctaaatcaagaaaaatcagaatgtatcattaaaacgttagaagaataaaggagatgagatccatgatgtagactgagcagcttagaagaaagaagctgaataaatctaaggtatcttaaaaaaatactttcatggctgcttatgacttggaatattttcttcttggctgggggaaaatgcatttttaaagccttatatgtaaaccagaacagtcaatttcctaagaactactgatagaaaataaaagtataagtagtctttcagaggcttgtacttctaaagtaaagagcttgtaagtttagtaacatatacatgtttaattactggtattccatatgcagggttggctgctattactaaaacactctgtacagagatttgctaagatgaaagcacacataataattatcgttatcacatgctgagtgccctcttacaccacacttcacagacattctctctaattcataaaacaatcctgtaaaataggaattatcattagtcccattatataaattaagaaactgagactcagagaagttaaataacttgcatatgattatgcagttaagtgatggattgaagatttaaatccacttcttttgtatggcttttaatacttgactccatatgaattggttttttgcataggcagacattttaaaatgtcctagtttatttactatgggcttacctcatcatcattcataaaatatttttaactgtctattttttaatggacattgttctatatgttgagaatacagcagcaattaagacaatgttccgaacatcatggaccagaaaattagctattactcacagaggaacagatcggcaaattgaccagggtcagctaatttgttcccaaactttgttttatttttaactttttgctttgggcaggaaactataagatagagtataacatgaggcttcagcatgcaggattgccataaccacagtggtcctcacatgtgacttgaaaattacatgaaaaatatgaatgatagactgactctacaccgtgctgtcacctggatataaactctgttcttggcatgtaagtccctccttcagccctgacatttctccaggaaattctttttttctccagatttatgatgctgtgttctctcttcccctcttcataactcttaaattccacaaggcaactatctaattaattcatattttataacacaaatgacttaacactatccttggattatatctctctggacagtacttattttatcaaatggaattgatttataatggattggatttagagataacatattgaggcatgaagatttcctatctcctttattctgcttagatacgactggcatgtacaaagttactcttccatagctaactttcaagaaaggcagggtcacaccacttgagaacatccaatacttgacattattttttgaaatccagtacaaactgatctgtgaagcataacaacaaggccgctcttcatggtctgctcttgtcctaaagcacaagcaattggtgtgatgacctcaataagttatataaaatccacctgcagccagaaaaatttgaaattgaaggatttaaggggaaatggagacatcttcctttcagcgctcttgaatagcaaaatgtcccgtgattcattcatccttttatgtgaaggggtctgacagtgactttagtccaacagcttccagacaactactccgcgtatattagactcatatctgaatacttagtgcaataattgaattccaataacctctgcaagctaaatatattgcctttattcaaggaacactagaaattcactgtaacagtgccctttggagttcataatttgagatgtccttcaaagtaagattgctttataaagatgccattttactgcctaagtaactaaaccttcctggccatgaaccaagacagagtcatggcatttaatcttattatgcatattccacagcttcatatacacaaaggtgtattctgtggcaagtttttcaatatctattggcaaaatatttgcagaaatttatttttctatttctaggaactaactggattgattctgtttcaagtgaaagaaccaaggacacacagtaaaagctgaaggcaatcttgaatttgaaattaaatctgaactttatgtcagtcacataagtaaagagaaggtttcagcaattatttaatacacttatccggttcagaaaataatccagattattgaagtatacatgaaatttccttcagctttgctattttttctgtaccaagtgaaatctttacatgtatacactaattgcatatttaattataattccacttcatcttagcaactttaaattaaatgcaaagaccctaaagttggctacagagtagagctgtgccacctcaaaactccattcaaccacacaataaattcctgtaattatgtttttaattaaacaaaaattccctgaattttacaggaatctgtcaacattcacatcaaaatgtactgcaggaacatgactattttcccgaacactatatagtattaaatgtcataggccttatactttcaagtctttttgtcacattacagttttctgctaggagctaaaatggtatatgagctggttttatagccagaaatagtcgtggcaaggttatattttttgatattttattatttgttgttctcaagagtaataagcaattcctacttatatttgggaagtcagaaaacagatgaaccacttacctgacaaattaaatgtgaaaataaagaatagactgcaaatcttttaaacactcatattttgatgttaaaatattgcataaacaacaacttttcattaaaaaacaagaaatgcacagtatagaagaaaaactaagaaaaaagattaaatttagatgagaggcagtcagctataatatccaaatttctaaattttaaaaaatgacaatataaaaattaaactggctatcttcacattaacaatggctcccatgattcactgatacttgatgaaatactgatctttatatacaaatcagacatcgaaagaatgtaatgtaactttcactacagacttctaagcctaatctatgagtatgaatgtgtgcttgttagcatgtgagtgtgtgtgagaaactgaaaaatagttactaagactcaactgtggatgcacttcaaagcacctactccccaaaattgtgtgttaaatttaacatttgcaataattgaattccagtaacacctttggatctgaaaacaggtaaacagttttcatcagatcctgaagggaatttgtcacccacccaaagtgttagaaaccacttcaaatctcagccatttgtttccatacagtcactgtttagtgtgtcattccatcttgtaagagagctactagtcttgcaggttgagatctaatgttgtctatgacactaatgttgttttgtgcttccacagtagctgctctttatgtttttagtacatagttattgaagccaaaactgatggtgcaggggagaactggatgaaagagcacatttccgggagattactatgaagaggactctatattttttccattattattatttttttcaggtgaatatttgaaagctattcactgtaaccccgcattcacagattttaagattttaggaaatggtaacacaaattctcagaatgttccctgagaaatatctgaaatcaatctgcacaaggaatcaaaacatccaaattcaaatcccagcttcatctctagttgagggacataaggcaattcactcaacattctgggcttctcactctcattttaaaaagaaagtggtttgttccatgatctttaaaccctgtttttcaaatttaaaatgcattgcagtactattcacaatagcaaagtcagggaatcaagctagatgctcatcaatggtggactggataaagaaatgtgatacaaatacatgatggaatactactatgcagcttttaaaagaacaaaattatgtcctttgcaataacctggatgcagctggagaacataatccttcatgaaccgatgcagaaataaaaatcaaacaccaggccaggcgtggtggctcacgcctgtaatcccagcactttgggaggccgaggcaggtggatcatgaggtcacgagttcaagaccagcctggccaagatggtgaaaccccatctctaagaatacaaaaattagcctgcgcagtggcgggcgcctgtaatcccagctacttggggaggctgaggcaggagaattgcttgaacctcggcggcagaggttgcagtgagccaagattgtgccactgcactccagcccgggtgacagacagactccgtctcaaaaaaaaaaacaacaaaaaaaacaaaaaacaacacaaaaaaaaccacgttttcactcataagagggagctaaaaattgagtacacatggacataaagatgagaacataaacactgagtacacacagacatagacactggggagtttcgaagagaggaggtgggggcaagggttgaaaaactaacttttgtatactatgcccgctacctgggtgacaggaccactcatacaccagacctcagcaatatacaatttacccatataacaaacctgcatacacaatacacctgaaactaaaataaaaattgaaaaaacaattacagaaatcttaagaatacaaatacgtcttattttggatagataagataggaaactacatttttagaattatcttctgtaccatttgcatggaacatcccaggtctcctaacacacattaatttggatgaagcattttgtatatattataaaattaatgactaaaacacactaaaatgaaagagtatataattatcctcttagccttgaaatacacacacacacacacacacacacatacatatccccccacacagggacagacatagacatgcagatcctcctctacttacaatggggttatgtactgataaatcgattgtaagttgaaaatattgtaagtcaaaatagattaaatacacctgaactcccaaacatcaaagcttagcttagcctaccttaaatgtgcttagaacacttatattagcctacatttgggcaaaatcatttggcaacactgtacgctcatagagtctcaattattcacccttgtgattgcatggctgaccggaagctgcagcttgctaatgccgcacagcatcacaaaagaatgttcaactacgtatcattagacagaggaaagatcaaaattcaaaaatttgaagtatagtttctgctaaatgcattatcacttttgcaccatggtaaactaaaaaaatcacaaatagaaccttcataagccaaggattgcgtgtgtgtgtgtgcgtattcttcaagcgcataacataaatactaatttacaagtaatgtaattttgaataaagatcatgtacaaaacaaactaatgaaagctttgccattatgcagatattccggaataactgaatgcagatattacttaaataatcagacacaaaattagggtataacttgagaataattcttatgataattaataatagtcatacattcccatagtttttaggatttttttgaagcattgtcacatacatcattgtttaaaacatcacaagaatacttcatagtagatattgctatttttttccataggttattggggtgcaagaggtacttgattacatgagtatgttcttcagttgggatctgtgagattttggtgtacccttaacagataagaaaaataagcataaattcttttcaaatgatatttcaagctcacccaaaatagtagagttaagataagaagtggagtcccatgacttcttctaatatttaagaactgcaaaattttttaaatcgcttttgcaaaaattgtaacagtgagaaaattatgatggtgacagagatctgacttaaacaactccatcttgcctttaacccccaaactgcccctggtcattcctgggcttgggccaagctaactttgggagaatttcagtttatagtttaaattttaatagcctttccccaaattaaattgcctttataaaataaaacgccacaaatttagggttatgagacgggcctgaattttgctaaaatgtaggagtatttaaatgattattagctcttgttccagaggtcataagatttgtaacgtccctagtcactcctttaagtaacatcactattatagaatctaagattgatcttttgagttgtcttttcagacttttgcatttctgaaaccagatgacttcactggatgactccactgagacccaagactcaagacccgaccagtcctgtggccctcacgtgtaagtggattcagcccacgagtaccattttccacacccttatgattgcattccccaaccaatcagcagcaaccattccctaacccactgtccacaacactatctttaaaaaaccctagcattcaaatttgcatggaggctaatttgaataataaactccagtctcccatttagcaggctctatgtgtattgaattctttctctattgcaattcccctgtcttgataaattggttctatctgggcagcaggcaagatgaaacttttgggtggttatattttcatgattagaagatcttgcacacagataaacagcaaaatttcaagtcaagataaaataggtgcaatacgcattcatttcttcaaagtgaaactgtataaataaatgccaagtagcacaaggcaatatggagccaatgattatcaagtttttattcttgaggaattaataatcttactgggaagacaaactgtgagcagattttcacccagcagctatgggaacacaaagaaatggaagctttttctgaatggaaaatctgattcaggcttcctagagaaagtgacagcatatgggagaaacaaaggctctcttctgatgatggagaaaaaggaattcctggcagtagaaatagcaggcaatggtgcaggaaagtactttggggcagagtacattcagaaggtgctgaaactttgatgtagctataatgagatattaatggaaggtaatgatgcaagatggggcttaaaagggtaatttatacatgatgaagaagggtcttgctgccaggctaagggttttaaaccacattccaaaggggaagagtgccaaaagcataaagactaattctgaaatggctctagactgctgcatggagttgaggtggggaggtgggtaatggggtggcagatccagattcagattgcctgtgtgtctcagcagctgtcattcattctctagccagatttaggtaacagattaaatttatccaattaatctttgcctgtagatttttaaatttcagactatgcgcattgtgcaatagcttcataaagattaacaattatttaatgatattatagaaagttctttattttatactgtataattattaattattaatcagaaataagacgtctcttacaagactcaatttataacatggtagtttgtgttaccaggaaaaacagtttccttgctgttaaacaagtccatgtttctaattttaacttaaattagaaaaatatccttcttttattggtcattatagttataaattctgctaaaaccaaccacttcactctacgtacaaagatcaagctttgccttccctaggtttttggtgaatgctaattaacattcctcagtataaccttaactgtgacttgctagttagccctgaaggacaacattctattttaagaaaaatatgtataaattcatggttggtttaaatgcagatgtagcctgttcttgaaagttagtaaaataggttaagcttaggttgttaccccagtcatggtattgcactaaaaactccagggatgccatcacataaatgcatggtagaaataatggatttaagataagatagaataaagatcgtaagatttatttttgtaagatgtaattatttgaaaatcaatatttaaatcataagagctcttttttttttgtttctacagctacacagtatgtgtgaggttcaatctgactatccatcctttatggaaatgctacattacacattaactcaaaggctgagaatccattaagtcaaggtgagaatcctgagaattagcatcatcaattgtgagttttcttttcccttattctaggcctccacgtgaggctttcactattgtccttagtctcttagcccatgataaaaatatatattttataggaatggtttaaggagatgcctttctgagggaggggtaatgacagaaaagtacatccattttttattagtattaaggaaaccgtattggtcattcatcactgacaaaacaatactttgttgctggctgtctattatactaaactgtgaatccatgaaaataaatttctgaaaataataaaaaacatataaaagtcaaatttgagcagtgatggaagtagggtggaagtacaatttagcaagagtctgaagatttttaataattgtgttattttgcatgaaatattatatgattttgctcaagccactggcttaatatattttaatgaatcaaataatgacaaaaacataagggctgccaaactgagaggcaatatataacaataaaattagtggatctggctcttcactgttggctatattctaggcccatttcaacattcagatttagctgaattatttggattccctaatattccttttccagaaataatgatgaattggcttaggggagataagaagaatggtatagcgggagaacaacagtcaagaatcaccattcatactcctgtcaagaatcaatcagttttcttagctagagagggaagcacgagagcacattacatatttgatcatgcattacccaaaaaccatttgtgaagttgggcaggctgtcaacattactcaaatgcactttgggcttttcgagctcaacttttattagatggatgtacatgtgaaaatccatggctttaattgctatagcaaaagaagcagtgcagaatgtgtgtatgtctttgagccacaggaatagaatcctcttcaaaccttgtttcttcactggtatgtccctagtaattggagagatgggtcttgggctaggctaggtggaatatcatataccagtacagaatgcaatccttcaaacattaggacagctaatgtataaatccaaaacttgtataattttagtgtcattagctataagaaaaagccactctctttacaattgtccagcagataacacatcaacaaaacatcatgaaactggccccagcacagtggttttaaggcaaaacacttaaagttacctttcagcaatgtcacaacttgaaaaatacacgcgattctctggtacgaatcacccttgcccatccccctccctcccactgaataaatatagtacaaatcagagatctctatggaaggatcatgctgattaatctatttcagctcttgaccacttgctgtttttggtataaaaatcacttctactgtggggaaaaaagtgacacattaactgtagaaatggaatgttgtatggttatactgtctgctaaatgcactgctaaatccactgagacgcacagcatggttaagggcaccagcactttggcattcaaacagtcctttattgaaggatacaggataagatatatttataatactctgtagatcaactttcaccaagctctgagcagcaataaaggaaaacaaatagggattttgaggaacaaactgagccacgactcactttgacactccaaatactggtatttttcacttagcagtagtgggtaagtattttcctggagtgacagttgaacctttaaaaaaataaacattttttcactgtaaacaaaataaattctggctgctccctagtcactttaaacagatgaataaatcaattcagtgggtgcatagggagagaaacgacagtaacatagtttctcccttcttaaaaactggaagaagatatattgaaggtgatgctatctaaccagtagtgggtaagaaggaagaaattcaggctgttgacattttctggtaagatcttgtaatgaactttagatgttttgctattttgttggttagagtccatctaatatattcctagaagtttcttacagtaagaaaacattgtgtgcatttgtgtgcctctgtgtgtgtgtgtgtgtttaatgcccaacaactgcatctctcacagctaaatttcattatgggagccaaaccagcctcccaaaggtaaaaatttataggagaaacttgaatacctgcagttacacaatgactgactgcactgtttcagctttttctaagtgtatagaaacttttaaaaatcaaatcatccactatgatgatttgatttttttaaaaaggaaaatccaaaggtctaaacccaagattcatgtaaataatatagtaaattgtgatatatatatagaatatatatatagaaagcaacatacagataagtctgaaaggaaaacttacccatgatcagtttaataatatgtcaattatttatgtcatttctcatataaatgccttatatgttcaaaaatagattcttgtgaatagatgctgattataatgtaaatatacataaacacacacacaagaatgcatctattctgctgagatatatttaaaggtttcttgtaatttcaactgatcaatggttttccttcttctgaatattaaataattttctaatgtaaagttacttctgaaaattaattttcataattcatatttattttagaaatgttaaagaagcattcattataagtgtgatatcatcactgtgctacttttcactattttattttttattaatgttagtctaatttttaatctctcaattacacaatgataaacacatgaacattatcttcatattggccctgttactaaggcttccagacactctatgtttgtgagacatgttctgtatttaatgattctgtcctaagtcctatattgagctcatcaggctaccttaaatatcctatattctgctttttattgataaattattttaaaatggctatttctcaaggtgcttaaatgactttgatgaaaacacaagctgaaaatcatgcttccacaagtaaatatctggataattccttatggtctctctagtagtttgagagaaaatcaaaaaggaggattgagaattaaaagtgtttttcatattcgagaaagaaaaagattattgtttgaccaaagactcaaatctgagataacttctaatcagttcgcaagctgtaaaattcagtcaatcaggacagtctcactccagtggccatgcttctgaaaatcagtcattcaacaatggcatcactccagtaaccgtgcttctgaaagttagcaagttagtaaaaatctcaaccttctgaaactcaacctaccagtgacagccacatgcttctacacaagagctgatcagcaaaggtctcactccggtgaccaggcttctgagatccagccatcaataagagctttaatccagtgaccactctaacatagctaaagtccattaatctctaaatactcctgcttctgaaaatccatcaattcttgaacagcagacttccaaaaacttcatatatcagttctgggttcactagggaagattttgccttacaaacgcagctctcctttacagtcaatgaaaagtttgcattagctgtcaagttaaattattattacttcaaacatttgcgaacctttttatggttgaaccttgtttatggttagttttgaattggacttgtgagtgaaaaacataccgatgctttgacttgagattatcatgtttaatctttttaactcctctagttgttagtattatctttttttaatttgtgtatatgtgtatacacaaattatacacagtataattctgtgataaatttttggaacagaggacaatcattaaatgagggaaaaatgcttttgaagttatttgttcagggtacaattgttcagtcaatataaaaaatgctgaaaagatgaaatagcacagaatatagctaaggaaaagagatatataattttctcaactagtaccaaagaaaagtgattaatattaaaactcagaagataaaataattacagcagaagttgtaatggctgtccactatttatatcattagtttcatagctccaatgactgaacatattgctgttataagcattttctgattccaaaattgcaaattttcaagtgtcaaaatgaaattgattgcaaaaattttttaaatgaaaaagttccatttactattatagagattataaaaatctaaatgtctcatctttttcataacgtagccacaatgcaagttatcatacttcagaaaaacatttccctttgattgtgtaatattgttttcatgaaaaggcttgcttagccataaggctactgtaagcaaaactgtttctgataaaacttcagaaataatagcaattttttcagaaatgctcttattcaaattgaagttaataaagaaaaaaatttttcttttatgaattgatggacatactacaaataaacattttggtggatatttatctgaaggtacaaacaatatttattaaatgattaagcaaaatatgaatgattctataaaagatgttggctgttctgcccatattctacataatgctgctaaaacagtagttgatgctgacatggtttgaaaacatcccccaaagttcatgtttttgaaacttaatccccaatgcagcagtatcaaaagttttaaataactttaaaaggttattaggtcatgaaggttcttccctattgaatggattaacatcattatcaatcacacattggtgagagatcatggaagtgggctcttgatagaaaggatggatttggccagatttcaattctttctagtacacccatgtgccttccaccaggggatgctccttgccagattccattgccatgctgttggacttcccagtctccagaaccatgagtcagataagtttctattatttacataaattaccccatttttggtgttttgttacagtagcgaaaaacagatttagacacatgcccttctcattcacactgaagtaattttgataaacttttttcttactttagtatttatactgttcacactgagcaattaaaatatttttgttattctgtttacattcagtattgttcaattctttcacattcaaaaacctgttggctctctttaacaaatgtacttgagagcatctcattttatttgaagcactaaaatcatactttaattctaaacaaaaatgccccccaaattcctattaacactttgtataatccattgagcaaaacctaattatttcatgttcatagttcacaatatctctttagcacattaaaagaagagcggtgttattgcagtactcttgcttaaaataacttgttgaatatagtaaggaattgaccaaaaaaaaattatccctgtgtcgaaataaatacactattacttataaacaggaaaagaaattccaaattgaaatggataattattaaggctcctgcgatgactaattcttataatagattttatcacttgaataattcaattttttacatggttgttattaaataatcactagcttgagaacatgcagagtcatcatttatactgttgaagagagatcagaaagaaaattaaaattcatgagaatgctattattttgtcactaagtttaacatattttttcattaatgaatgcttaatggacaaaataactaaataaggctgatgtgactactgtacagttgtgttgcaatgtaaatgtaatatagactgtgactgcaagagattttttttttttttttttttttgagacggagtctcgctctgtcgcccaggctggagtgcagtggcgcgatctcggctcacgactgcaagagattttaaaacaaattttgtaaatcatggaactgttaaaaagaggcgagtcatcacagaagtataatcaaggaaagagacacgtaatttagatactcataattcgtttcatgtaaatgacaatagtgttttttattatttgtatatcccagacaacatttttaaaatctcagtgtatgtattcacaggtaattggaaatcattctgttttaactgggcatcttgtattctatttgataaatctgacaaccctaaggagcatgaccaatttggaaacattttagtgttgtttcttggactgtggctccttagactgagggtatggtataattcaagtcccaggactgctgagaggagagctatggataccaattattagggaagattattaatccagacagtccctaacttaaaatggttcaacttaggattttttgaagttataatggtgggaaagctatgggcattcagtagaaaccatacttcagtacagtattaagtaaattatataagatattcaacactttataaaataggtcttgtatgggatgattttgcccaactgtaggctgacgtaagtgttctgggcatgtttaagctattaggctaaggtatgatgtccacaagttagctgtattaaatgcattttttacttacaatattttcagtttaggatgagttgatcaggaattaacctcgtcgtaagttgagaagcattgatattaagaatactaagttcttcccaacaagttccaacagagatgggatctgttcttatttttgttgttggttcacttggtaagaatttccccttcaagattgtcattgttgagcacctgatttaatatgtttggggaatcatctcagttgtggctctcccactagtcgagttcagatcctgttccacagtggcactaatggccagtgaagcttcaagtttctgggttgagcatacctcctggtcagccctggcttctgtgtgggcttttccacctgtacattaattttgtttttttttgtgcatttcagaatatctgtgttaaactacagcagtagaaacatgataaagtctgttttagaaaatggatttagaatcaagtttatttatgaattttaaaattcagccaccgtggaacatacctgcaggagtttcttgtaatttaatttttttttatagtaagacatgcttgttattttaggaataaaacaagttctataagtctcatttaaaaagagcaaccttatccacacattcttctacaacatgccctgcctcccagtggtaaccactttgcacttttaattatttcatttctcattgggtttcacattttttaatgtgttatcaatttttatagtttattaattttaggcattgaatttgacctcttaccataaatgatgagaacttggcctttacagcctcccccattttcatgcaaccatccttttaaaataatcatatcataatattgaataatgtttagaaattgcattatcatgaatgtataagtatagtttactgttatgctaaataatattgtcatatttctcaatattttctgtttctcatgagcaagggtatttagtcttcccaaatatatctgtccttccaatagccaagtgctgctctgtctgttctgtgtttggaattcaggattagaaaattctagaaataaggattcaaggaaagaagtcaatttcagctcttatagaaggataacttgggtttctcaaaggtgagcagggccgtggagagaggttaagcctggcactgctcatctgccctagtcctagaccccttgctcctactcagaggaggtatttaaaaaaacatttttcataataatttcttaagaaaaaaaactacacaaaatgccataagccattcaggggcttttcaaagtgacaaacaatagagatcccaatgcaagacctagctgaacataactttaacctgtttcttctctaacttgaagtttatatagttatagacagatgggattcgtaaggcttcatacagctagaaatcccgcactcagtttccagaagagtaagagaaaaggagcttcatattttgcacattgggaactgaaagtttgaaggtggctgggccattgtgaggggaaaaaacactgaccttgactatgttggtggggatcagctgttacttgcccccaagatccccttccccttctgatggaggctgacaagttctgctgtgctaactcagcattaatgaaattctgaagcaatactgcaggtaccattcctatgccctcatattcagctagagcagaaaggcataaaaaacttcagctctgtattttgtgaacagtggagcagacaaagagattgttgctgctcctcttcaccttcctagtcacagagagaattgtttcttgctcaatggtcccattcaaagtcactagccttccctctgtctctcagctccggagaatctcagataggctggtgtgagtggtaaaggtgtgtgactatgtacagggtgaccttggctacctgactgtaggacacccagggcttagtatgcgatgggtatgataaagcagaatcctttggtctcctcctgtcatgactcttcctcatgacaggaggagtccaaagaacaaagcaaaggtcatagcaaaactgagaaggggaggaatagatgccacgtaggccaggagagggaatcttagcacaaaaactgaaagcactcgggttactcacctggccactgcagtaggtaccggcttcagagttacatacaccacatgtggacagggccacatttccccctccctaaccctaacagattctagctctgaagggcataaaggacaagaacatttttgtgaaaacagtggccgttttgcatttttgaaaatgttgaaagtgtcctgtggacaccgagttggatgaagaattgctgtagtaggcactgggctggccacgtatccatggaccagggatatctaacaaaaggaaaataacttctctgaggtcacatagcaagccatacctggctctcagttctttatctccagatacaaatccggaggaaagaatcatataaggatttgaacacactggggctagaaagtgacttgtccaaaataaactaaggacatagttcagtaaggcagcccattccccctctgtttctagcatggtgtttcctcctacacaacctcccacctatgtggaagagttaatatggtccaaaggaaagaaaaactctttagctgaaaaatgattggagaatgaagtaatattttactaaaatttttcaaggctttgtcctcagccagggtcagaagatttgaaaaattcccaggggcatcattcacacattttgcagacttgttatccagtaggataacaatggtgtaaaataggggaaaaagaaaaggggcttcctggaattataagacatgaagtcctataccataagtgtaatatcaggacaaccaaaatgtataagtgtgctgggagcctggggatggtgggagcataaggataccaggaatcagcagctggagtcacaaatatctctttaatgagttcaggttaaaacaaacaaacaaacaaacaaacaaacatgacggtgtgggcatggagaattgaaccagaatccaagatataagagggagtcaaggctagcatttggtgttcttctctttgaggtctttcatttagaaattttatagttccttaaatcctgagctaaaattgggctgtggttacaaggacaggtacagatattactagtcaggccatgcagcatttcaagaacttgtggcaactgcctcctatccccacccttgggactcaaggccagttccttccttctaccagaaagcctgagacatagtgcactgctgtgcaagcttagatgtcatgccagtgcttcaaagtaagaggcagtttgggctgccaatgagtcttaactatgcaaggctggttcaacacatgcaaatcaataaatgtaatccagcatataaacagaaccgaagacaaaaaccacatgattatctcaacagatgcagaaaaggcctttgagaaaattcaacaacccttcatgctaaaaactctcaataaattaggtattgatgggttgtatctcaaaataataagagctatctatgacaatcccacagccaatatcatactgaatggacaaaaactggaagcattccctttgaaaaccagcacaagacggggatgccctctctcaccactcctattcaacatagtgttggaagttctggccagggcagtcaggcaggagaaggaaataaagggcattcaattaggaaaagaggaagtcaagttgtctctgtttgcagatgacatgattgtatatgtagaaaacccaatcgtctcagctcaaaatctccttaagctgataagcaacttcagcaaagtctcaggatacaaaatcaatgtacaaaaatcacaagcattcttatacaccaataacagacaaacagagagccaaatcatcagtgaactcccattcacaattgcttcaaagagaataaaatacctaggaatccaacttacaagggatgtgaaggttctcttcaaagagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagacaatcctaagccaaaaaagaaaaaagctggaggcatcacactacctgacttcaaaatatactacaaggctacagtaaccaaaacagcatggaactggagaccaaaacagagatatagaccaatggaacagaacagagccctcagagataatgctgcatatctacaaccatctgatctttgacaaacctgagaaaaacaagcaatggggaaaggaatccctatttaataaatggtgctgggaaaactggctagccatatgtagaaagctgaaactggatcccttcctgacaccttatacaaaaattaattcaagatggattaaagccttacatgttagacctaaaaccataaaaaccctagaagaaaacctaggcaataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctacagaatgggagaaaatttttgcaacctattcatctgacgaagggctaatatccagaatctacaatgaactcaaacaaatttaaaagaaaaaaaaacagacaaccccatcaaaaagtgggcgaaggatatgaacagacacttctcagaagaacacatttatgcagccaaaaaacacatgaaaaaatgctcatcatcactggccatcagagaaatgcaaatcaaaaccacaatgagataccatctcacaccagtcagaatggcgatcattaaaaagtcaggaaacgacaggtgctggagaggatgtggagaaataggaacacttttacactgttggcgggactgtaaactagttcaaccactgtggaagtcagtgtggtgattcctcagggatctagaactagaaataccatttgacccagccatcccattactgggtatatacccaaaggattataaatcatgctgctataaagatacatgcacatgtatgtttattgtggcactattcacaatagcaaagacttggaaccaacccaaatgtccaacaatgatagactgcgttaagaaaatgtggcacatatacaccatggaatactatgcagccataaaaaacgatgagttcatgtcctttatagggacatggatgaagctggaaaccatcattctcagcaaactattgcaaggacaaaaaaccaaacaccgcatgttctcactcataggtgggaattgaacaatgagaacacatggacacaggaaggggaacctcacacactggggcctgttgtggggttgggggaggcgggagggatagcattaggagatatacctaatgctaaatgatgacttaatgggtgcagcacaccaacatggcacatgtatacatatgtaacaaacctgcacattgtgcacatgtaccctaaaacttaaagtataataaaaatatatatatataaaagtcactgattgggagattcctgttctgcttacttgcagtctgcttgacaatctacatttgtagcagaaaaaaataataataagctatttatgactgtctcccacttccagaggagaagcagatgagactagaccccaagagaaatgaaaaggtatttctgccctcctgtcttccagaaagttctggtcttctgtactcagagattgttaataacttgttttcccaaaccccaagtaaaagtgttaggcaccttttatgcaactcttcttgtgtgggaggtcaatttagatgggtattttggagaaggaagatgtgaaggttgggaacgcggcactgctaggttgaaaggtgaaagagatgcttaagggtgacagggacttgagaaagtaatgcagcaaaagattccaaagtggcaagatccttgtggaaatcttgaattaagtaagactcttgttttgtagagcttatttgatgcctggagacttcaccctccaatactactgtcttggaaactctagctatagctgtcagtgcccacacttggcacaaaggctgtggagacaactgcctttaatggaccataagggcttcacaatgagcttcctggcagcaatcacaatgggcagaagccagaagctccatctaaggtattttttggatattatgtgccatactaaagaagaaggtctccatttattacagatattgatctcttcccatagtcatggtgtgacttagggttaaaattaatttaggaaaatggagtaatgggatattttttgttcctagtgttgtggaacaaaatcatgctgttacatttattgtttcatttaatcttcataagcccttcaaagtagacattgtttcctttcacaaagaagaaaacggagtattaaaaaggtactatgtatttaatgaaacacataaaagaaggaagctgggttggagaacctcctcagattttaaaaaagcctgcggatgtaactgacagaaaaggcaatctaactaacttaaataactgatatttgtaaatgcaaaatctgggagtagggatggcttcaaaccccagagttgattcagagactcaagtaatgtcctaaggattcaagttatccccagtttttggctctctgtcttctgtactgagtttgctttcaagctttgtgttgtagcgagatggctgccaacaagttcagagctatattttcttatgttgaagcacagctgaataaatggtgcctctctcagcaaggcatctacatagtcttattgagccttattggctccagttagatcacatgtccatggttgaaccaatcaatccctgtggccaaaggtatggaggtatgggtgttatttttagtcaggcctgagtcacagaccaacccttggagaaaggatatggggaaaacacatctccacatgcacatggtaaaaagactgagaaacatagcttgtttttttcaatagggtacactttccaaaaagatgaaggaatattggatttcaaaataaaaacagtaacaaagcagatatcttctgtagccctctttcattgtccccaatcccatctattggctctctgccacgtgtaacatgccatttgagccaatggaactatgttccattacaatgaaaactgtatcttccacttacattatcttctcagccatattgggtggaatttggctcacttagaggaatggggatgcattatattaacaaatactaattacatttcctgctttaggtgtgaactctgcttctcctattagacttcagcaaatcaagaattcaacaaatcaagaagtcagttgattcgaaggctatattgtgcaatgattagatgctcttatatttcctagcaaaaaataagaatgataataaagctatcattcattaagcacctaatatttgctggctctgaaatgttccatacacataattactaatcagaaacatgccatgcacataattactaatcctcacagcagcctgaaagggaggatactattatccctatttactaaatgaggatactctagttatgtgtagtagataatttttgacgttctttcccaggtcatgatgaactgttaatcacccactcttactcacttccagtgatcttttcctaccttccatatgttttgtaaaatagagcaaattggtctgtagaaagaagaatgaaacagatggaccacagtagtctagtgtcttctaagttccccataaaaggtctgactattgctattaggtttcataaaatactcctaacatatttaaaacttctctgcaagccaagccccaaagaaaatgtatgtattttaatcaaaaatcaaaataaacttgctcaagatcatttcaccagaaagtactggggtcaagatttgaaaccaattctctctgataccaaaggcagggttgaaccactgcaatgtgctttcacttccaggtgctgcaacttgaattcccaacattgacatatttaattccaaagaacattacaccagcttttagtcaaatgaaaaagttaaccagctgctatcttagctgtcaaatttctaggaagcagcttaaattgtaggagaatatgaatcatcatggatatcctatgtaaatgtcaattagcatggcttctgttaacaatgaactccttgctttcactatttaaaaaaaaagaataggtaataaaatcaacatgctggatttttcaaaataaaaaaaaacacaaaagtacccgtgttataatattacagtgatgatacctatagttagaagtgaaatggcgttcgtgggtgttataaaagagcaaaatcaatttcatagtctaaactacatattatttaaaaggagcacatattgaaaagacatttaaggttctctctacataggaaagcactttttcttctgtggtctttgctaagtaatgagctatttataattagccaactcatatttaacgtaattttctaaagtatacagcttagattttattttgccaaaattatcatggttcatggttcattgccttcaaaattatcaacgtggttcattgccttcaaatcttcacatttggtttagagattctttcttgctttaatcctccactaagtcaaactgcttgcaaatacactttacagtaaatctgcactaaggggatgcctagttgtacttttcatttacgcttgcacttgccttcttctggaactggtattttacagtaatagctacacattcttagttgtttgctaaagtgaagtcttgtttacaatatatagaacagcgtatataaggcgcactatttcacaattgtgtaattacagcagccaaggcttaagttaatgagtttcctaaatagctttagaagagagatcgcaatatgaaaagcttagcgtggaaaacatagggattatctagtccatcagagctccatctcaactattctagaaagatagctttatatcctatttcaaaaactgtccaagaaatagattccaagttaaaatctgtatgaaagaatactccccaagactgctctattactgatttttcatgtgtgaaatggcactggagatgtggtgtataaatttgaaatgatgtctgaaccagttattttctttaaaacgtaagatttcatttgaagaggacctattaagtaattctatgagtaaattcacagtcattacctgacaatctgcttaactccatcacgatcagaatggatattcatgagcataaatagtcaatattggctctaggaaatcaattactccactgttatccatcaacaatcctcttgagctcaggcttcatatctatcacttaagataggtgagaaaaaacccctttcaatgatataaaaatagcacataatcatgtgaagttaagtggatgccacccagtattagatgtgggaattgtgagacagaaatacataatatcatcttaaatgtagtttcatttgcttgtttgtttgtttagtgtatgttgagctcaactttttccatctagtacctatctttcactcattccatctctgaatgatctggataggttttctaaacaaatgactttattaagatgatacctccctccaaatcattgaaagtgtttctgacacaaaggtgccctttgcagcctggaaattctactaattttcaaaatacaattaatttctcagggtttaaagaatgagttttagtctatagtcttatacttgatagtgtctgtagcagttatactattataccaatagtgagtgtacaaaaattacttgtggttataatacataaagtgaacaggatttttcttcatggaaacaactaatacttaatgtaatagaaaacgatataatatatgatttactaccacaatttcacctataaactacattacaatggcccaaagactgaggcagaaactaggaaagtaggatcacagcgggggaaaccctagagttgtattgtcacattgcctgtgcatctgttttcatgtttgtacaaattctggcaaccagataataatagctgatgatgacaaatagatatttgaccaattaaacataaagatactagctaaaatgggatacttttgcataaaggtaaaacacattgcttttttaaaaacggaatttgtgtatctttttgtgtatcattttgcacaaatgcacactgtgaatacatgtaaaactaaaattctgcattgaatacacatcacaaagaaacagaaaggctaatggaactttttactgtaacttttggtaaggtcctaatgatagcatatacttgagagggaaggatattataactatttttttgaacactgaaatttgaaatttgccattttccttttttcatacctaatatatgatacagaggtgcatattaaaatactgaggtagagtttctgcacagtagaagaggatttgccacaaattttcttggccacagggttccagttatcacaatcaagtgacttagtctattcaataaaactgactaaacatatttgacctgattttgaaagttgtttctttttttataactgtaaataaaataagtgttcactttttaccaaatcttaggctagtgtttcagttggatgcttcttaacaaatatattgacttttttctctagtgatatcataagaaaaatcaattcttagtagagaatattctataatagatgcatgaaccagccaacgatggcttttatctaattgctatatagattgttttaaattttctctgtaggctttagtgctggataataaacaagagaatccaactgtattttgtagtacatttaagacctagcttgtaaagtcattgcaaatattttatttattctcaacaatgtatgatatcaatgcctttagcataaaactgtagcactttctttgatgaatacataatatacatcattatctttataagtatatgcacagtctgatagtatagttcaaatgacccattaattacaactttgaaacaaagcaagttctgctcttttcaggacagctggattgataaaggggactgagcatgcctgtcttatccaggcacccggtaaacaagccaggctccagtgcgggtcccctgtgttccatggctatacatctcatgtttatatgctttaaaaaagacaaatacgtctatctatactggcaagatgcaaaggtatctatcaattctttataattagtaactgaaagcaatgattcaatgataaaactatgagaaaaatacaaagatattcttcacggggttgaatttacagtagagaggttgacataagatgagtaatattccctcctcgaggcatgaaagggtgtgcctggggaccaatttaatttctaagcatggggtaaggcatctactagctttggtccacacagcttaatagagaaaaaggctgaaaagtaaaaatatgaatcttcaattgcagcagtttgcaagtcctcaaaatcaactgcacttcttggaatggagtttgttaaccagaaatgcaatcagaagtgccgaagtgaagaaagagctattaatagagaggaacagtcactcaaagattacagcttagtgatcttaatgcagtcatgaaattggacatgtgggggtctctgcaaaagtcaaaccaagaattggtcaaggccacaaatggcttgtatcttaacaaagctaggcatcaaaagcaacactagtaacagtattttaaaagtacaaaggtcttttgttcaagtcttttcatcgttatcagatgcagctatttatcagaagctgtaagtttgaaaccacatatcataaggacttttgcctaagcaataagatattgtatagtcatagaagtacagcttccatgaactagtttgttggggttttataattataaaactattttgtatgtatgtctgtatgtatgcatgtatgtatgtatatatgtatttatttattttgagacagagtctcattctgttgcccaggctggagtgcagggacacaatctcggctcactgcaacctccacctcctgggttcaagtgattctctggcctcagcctcctgagtagctgagattacaggcgtgtggcatcatgcccagctaatttttgtatttttagtagagaaggggcttcactatgttgcccaggctggtctcgaactccaggccccatgtgatccacccacctctgccttccaaagtgctgggattgcaggtgtgagccaccatgcccagcctattttgtatttttaatagtctctcagttatgaatgaataagtaggtagcttatagacagctatgataactaataaattcagaacttctttgagagttatcacacttaattccaaaggaaacttatctaaaagaaggctaaataggtagtaaacatccacagaaacaaatactaacaacatcaaaatgcaagcaaaagttcttatatacatcttacactcattcatacttttgttctgagaactaaaatatcctcccagtattctcacttgagaaaaataaatagctcagatggaattgtatatcaataaaggagtgtattcactttggtaaagaagaatttgttctccatatcaaaaaaaaaaaaaaaacaaaacaaacaaacaaacaaaaaaaacgccaaataatgatctgcttattttaaaagaagatttccagactccagggaaaatagcaggtggccaggagcctgccaaatgagcctgccaggaacacagcagggaggttgggtgggagcgaggacagctcatgtccgcttgccagttcagtggtgtgagcagcccagtggccagctgtgtgatgtggatacaagccactccaatcctcatccttttccagatggtggagtctttggctgctccacctgtggcctccagcaatgcataattaaattcctggctgtgctatatacttcattcaggaaatgtccattctctcttttaaaatccaggctttgaggaattctactttggtctgtttcttcacagttgtgtagatgatggaggtataacaaaagcagcagtcttgaagcccttatactaaaaggatcaagagcaaattcagtcccctataacatcttttataagtaggatccaccattaaacttcatggatagcatgtcaaaaagttaaatgtttttcatcaacttgttgtcagatatgttggtttatgaatagttgttgctacttctgttatatagcaactgcaaagctagcttatttaaagttactataagtttttagtctttattggaagaagtgaaaacagtctctgcagcaagactcaaaagtacctttgttttctaggcctgccagggatttttctatgaggccctaaaccatggtctctgccaacaactcctccatctccccatggctctcaagaaatagaactgctccatcctgaaggtaattgaatatcttacctaagtgatttcctcattgtttatttacattatggaacatttttcttgcagagttagagtataatctgtatgtaatactgaacaatattattgtaagctgcacaaaaacatacccataaatgagttcattaagtattagatatttaagtaaatgctgttttaaatggtttctactgtgtaaaaattgttggtggcttgttaaatagatgtttgaaaatgtttaaattgggaaaaattgcttggtgtttttctatgaatgaggaacagcttttttttaatatttaaaataatgaaatatccaacatattttcaggagcaaatcagatttggataataaagaaagtttattgtttaactacttttcttctctgtaaagagactttaataatgtcttcccattttaactgacaggccatcaatagatggatttgtttattgtttacccaattattagtctaaaaagcacttgctttaattcactataaaaatgtatactcaactggaccattaaaacaagactaagtgatttatagaaacgctttttctatattaaataaaaataatttcagcaattaagcacaagattagctctgaggctcctgttaggcaaggaaacaagagaaaccatgtgtgttacatggtatttactgtttagtgaattgaaacataccagcatagggttggaacaaatgtatttcccaacactgtactcatttatttacaataaattaaatgaatacaaaatgcttttgaaaatggcaaaatattctacaataataaagtatcactagattctactataaagagctaccacaattccactccaccattgctatgaaaaaagatgatcattcagtgagaatgatattggtgtacattttccaagaaaactatggaatgaagaatcagtttatacttaaaaggtaattaatttcagaaaagcagatttattcaaaacacataacaataataatggcttaaagggacttctgtttgtttgtttccccagtaatgaggacaaagtcagctatgaatgagcttatttttgactccaccattacaacatgacaatattgcattcatgacacgttatagtttgtattgtttcattgttatatgtttatatcaatgaatccacaacattcactaaagacacaatactcttttcctagaaaaaggaagcaatgtgtttataataccaaaaatgtcataagcactattataataagcatctgagagtatcatctctttggtcacatggatgccactgaagcatgagaatctgtctgtgaaggccagtgtgaattactaaatagagtgatgcaaagtgtttcctgaggaatgaaatttttattttatttaatataaatcgaaggtcaaaatgagctacaaaacaaggagctgtctggagttgttttcaaacgaagcatttttaataacttaataacaagcagtaattagcatactagctgtttgtggctaaatacagccttttgaactgcatagaggcacgagaatagcctgttcacttaactaatttacagattctttctcaaagtcttgtttttaccatgaatttacactctgtatataaaaagaaagaatatcttgataccatgaccttggccacaccttccacatggtagatcctaaatccatagattaacaaaatggaaataagagaaaaaaattgagaacaaaaataaaaattaatatgttttgctccaaaataaaccatgttttttttctctgtaaacagatcccttggagcctgttgagttttgtggaaaagaaaatcacataaagttttctccgtgacacacctagcaaggcattttcaagtccaatttatttacacaggcctagcagtaccctggagaatgcatattttcatattttctcccactgtattgaacccatgctttgtagcagatgtcatagagctgatatcgcagatagccaagctttgctgtagaagcatgtgaaaagacagacatccaaagaaacattgcaaatgtgtactacattatcaaactctccaaatttaggcttattcctagaatacaaatatttctcaacccagcaggcagccaggtgcccgcaaatcctgaaattataaaaactttggccaagttgatttacttctgcggtctcttgttgaaaaatgtgttgattcacattaatggcttgatgaaggggggactggaggactagaggtatcagggtgaataggacttgatgggttttgctctgtaatcagagtgtcactcaatcagagtgtgtggcaattgagtgagtggcacaattagcatcttattatggtgtttgctttcttctctttttatacggcataatttggtactttattataccatttcacattcgttagcacctcatgtagcactcattcatttggaagtcatttctcagaaaaattctgaaagataaaactcctgctgagaaagaagtacctacaaaaatcccctcaagtcctcactcatagctgcatattctaactttatgcaaaagctaccaagtttgctttacctgtctgcagcaggtcagaactagcaaaatgaaaaaatctagaatgtgttatataaagctagtgaaaaaaggcagattgagagtaccaaaataacagctggaagtgtgagaagagaaaaataagtaacaaaactcaggctgaagaacttcaaaggtataacatttttctcaggttgcattctcaagaaacagattctaaagtacggatttgactaatttatcaaagaagtgctccctggagaaatgagcaagggagtggggaggcacaacaaggaggctaagaaaccaagcaaagttgtgatttttaggtaaaattccagcctaggcttaccctgattgaaattgtgtagaatatattgcatctcagagtttgtcttaaggcaaggaatatgggctgttttgtgttcctttattagtcattcattggcttggggccatggggaggttggtgcaggggaatataccccatgttgcaggagtctggcaaatagaaacaaacaaacaaacaaacaaaataaaagttaactaaaaacaaaaacataaattgatttggccaataatacatttggctattaatgacaaggaccatgagtggatagagacccagttatcaaaagcctaatacattttcagatactaaatgatatgttttacttaaatttctgatacatcaagttgcaggtacataatttttttctaatagcttatgcatacatcaaagtgagtgattattcttaaaaccgcctatgcatttaaaatgtgtcaatatgttgatgttatatttttccagagaaaagaaatatagtaaagacatacttataaatgctttagtttatgtatttttttattctaagaagctattcagagaaataaaagtcttccttttctaacatatttgttagtattttcagaaaaatccatatttagatttctgaaggcaatgctgtatctccatacagaaggctgaatgacaatttaaaaacaagccctaatccctagtgactgtacatctgtgtcacaaaacaatcgcataatctggcatgattaaaaggtttgctgttcagagctcaacagctgaaagccaaatatggcaaagtatgatctagttttctgcttcataaatgcaaataaagactggcacatagagtatagaaagcagttgttcttatacaatttaggtccagcacacttttggataaagaagatgtccaatagaaaacaaatcctttgaaaacaaagctagacactcaagttttctggcttacactattgagccaaagtttctgcttttacaagtatgtgtttaaaatgaaaatacaggatgacatgtgttttgataatctgtagaaggactttaaacaccctgatcctctacagcaagttcacaataaaagtctgtacagaattaggaaaaccaatgacttgtattttaaataatcattcagtaataatgtagacattttcctgcttgtagatactatgcagaaagtattgttatctttgtctgtctagtactgagccataatccctggtacacagtaggcactcaataaatatttttgattgaatggatgactatagactgaatggatcaagaaatagacaaacatgaattaattttcaaaaaaaagttgggaatcatagtggtttctgaactgatgtctgcagaatattctaaattgtagccacattaatgtaaataacccaccagaccaaggaggaaatatatattagcatgtcaatatttttaaaagatacaatttatattgccatatttgtgaggcacctgattataaatcttgcattctcttccagagctgtctcctttgggaaaaatgaaagaggaaatcacattaagaataaaattgtcatcacaagattcattttattaacccagtatttccttacttgctgcaaatatgctggcgattttggatcagacaatccaggacagtgttatttgaatttattctttggcatagttcctagtgtttttgatgtaacccagcaatatctccaacagcaaagctgcagaattctgctgtccatttttattgaagtattgaatgtaattgagactcgtctgcttagactcacccatgtatactagggctttggttttgataaacattgtttcttctgttttctctacttcagtgttttactcttttaatcttctttttcttgaattttagccttcgagtttttcttccgcagattttcatttctgaatattaaaccatgcaaattctctatggccttttacagtatgactttctatatatgccttaattccaggtggcaggacagaccatttaacaatgtgctacccaaactcactgtggtgatacgcaaactcactgtagtttgtgcaaagtcctacagttcaaaatgcatacccaggcactacagtgttaggcaatagtaaaaaactaaatgccccaaaagaaggcatgtaaagatagaaagtgcccacataatcctcaaattcaaaaacaccttataaattaactgtgtccaaagactttggtttttatgacttagggaagcctaatctttgctcatatgagcccttgttcaatttggattgtcttttagaaagacgagtctactgaagcagggcaaaatgtcactttattttaaattaagattagaaacaatgacatttaattatcataatcatgtgtttttcagtagataattataaaagacaccacggtttaacatttagcttgtttccaaaagaggaaaaagggtgggaagtatttttatttaacaatgagagtatttagaggcaaatgattttatctgaaatttactattgttaactgttgtactgtttgctgtaaattaatctgaagtaagtatccatagaaaaatgtctctttgaaataagcatttctaaaatccttgaatatatctagtttggcaagtatgtaattatataacacacatgtcatatttacaattgaaatggggcaaaattgtacatatagagagacctaatatgtgagaatgaggaaaggtattaactttttagtagtatcagatgccacttgagcactttctacatgtgcaagacactgtgctaagtactcttgcaaacatgcaggtaagcactatttttatttgcattttatataccagagaattgatacatggatatgctaaataaggagtggaattagggattcagactgaggaatagctaaatctgaagccaagttcttagccactaaacttgtactctacagtatgattactattcatacgtagttattgagaaatagaaatgtgtctagtttaaatttagaaaaactataaatataaaatgcacaatgtttttcattagtattagaaaataaatacctcaataattttatattgatcacatgttgagatatttggcctacaacagttgaaataaaatatattatttaaattaattttatctgtttcttttttcttttcattgtggttactagaaattttaaatcacatatggggttctcatctgttgtttcactttatttctactggaccgtatttcactacactgtatagcctccatctctgacaagttaggggagagactctgaaatgttaattccctgcttagtttgtcttttcctcttatttatttcttgtttctctctcatgacagactttattttcttcattttaatgtaactatttatataaatattgtatatctctcactaaaatgtaagttcctggaagtcaggcctccgagttctcatcttgtaacaccaagtaacaagggaaggcttttaaggcaaataacaatctcaagcgttttagcctaagttaagcttcttcttcttcctcacaagctgtcttctcattacacagaatggagtcaggaatgtctccatcaggactgctcaggggtgtgcaaactgcagcttgtggccaaatccaacctagcacctgcttttataaataaagttttatggaaacacagccacatccactcatttagtactgtctataggctagctgggatacaatagcagagctccatagttgctacaaagtcctatggtcgtcaaatccgaaatattcaccacctggccctttagggaaaatctttgccatttctcaggtagcttatgctatcagagtcgattctttctttttgcgccttccatctcaagtatcaattacactatagtgacattagaatctcatgaaataacaaacatttttcacattgtgtttcaaggatgcttacattttaataaccacttgtagaataaaaacccaggatccctttgtgactatttctctcagttaaaatagtgggtctgagaagatgttttgatatgtctgctaccgtgacaacataaatagggaccatcttttaaagtttattgccatctgaggccccttgatttcaggatttcaagacttacaatgggcacatctaaaacagctactataatacttttaatgtcagaaaagtcactgtgaaaataaagaaataaaagatgtctacctgctggtgagtgagctctttaaatgactttactggagaataaatgactttactggagactctactggagaataaatgactttactggagagactttactggtgaggaaagtaatatagatataataccactattcctgtgacctatcaatacaagctattttacactttttaactatgccaagtgggtcatttaaggataatacagactgagggaaattctcattttgtttgaaggaatttgtttgtcttgatacaatcaattgaccttaactttcctagatgtggaaaatgaggtaaaatttgttactcttaaacaagatatattgttcagcaagactagaatgaaaggataccaaaacatttactctttactgatgcttccacaactagctattgtcaacatttccaatatcatccttacagtgaaaaccactatgacaagtactgtgcatgcaattatgtaaaattgaatcataaaacgagttagtggaataggaggattatataaatgttcaaatatttttatcaaattgtacaattaactagtttgttctgacaagtgttcttacaaaaaacaaaatattaattggcatatttcatataaacatatttacatttcatttattaggagccccttatttgttccagtgaataattagaatacatttacagcaaatcaattgaaacattcagtaacgtctttaaaatatccgaaggaaatgtgggaaatacctgtcttggtattctgagattgcaaggaactgtcttataaaacaatgcttctcaaagaggactaagtacacaatgatccattggtgaccagaaagaaaaacactaaaccttgatttaaaaagcaagtcaattattaaaccttagtaatgttgaaagattgattgatactgacaccttcattgagtcctaaaagtcactgatcaaaagaagtcaccatgaagaaaaaagggaattgtacaatgtggaggttttgacagtggcattctcattcatatattggttttatcatgttggaatatacaggagtttatattttttcctattcatattttttcctactcacagaagctagaatgtatttcacaaatgctaaaaatagaactcacactaacttgagcaaaatagtagacatcatttgcttactaatgaagaaatttaagcctgaaactgccttgactccaaagtatgccatagaactttcactctgtttctacattttcaggtctagcttgtcagttgctcttattctctcatgctatagataagagtttcttcacgtgatcagaaagatgaccaccagccagcctgcctttcaccttacagctaaccaattctaaagaaaaagagaccaaaaattccccatctttcatgtgtcaaatctgattgaaatacccttactaatcctagttggtcatgggtcaattccttatagcaatcactatgggtgggtagaggggtggaacaatgtgatgggccaacttatgtatcaagtaaccaaatcagaaccacagagtaggagaagaaccattcctcaaagaaagtggagttccagaaacaacaaacaactggtgctgcctagaaatcttagaagatatgaaaataaaatatcccagttgcattacagcatgcatgttaagaaatcataatgtaaaacaaattaatggtttgcatatgtttccaatttatgatctaatctggacactcatcaaattagaaatattgcagtagggatttccatataccaactgctgaagtaatactgttttcacagattacactttttaattacattctgtagaaagataaaaaaaaaaaaacttagtactatctttcttatattctcattctatggattgattggggatattctaacactttccctaaaattatttttaagatactttattttagaacacactgacatggtaaggctctttataataatgaatcttttattaaaaataaatttcttttctggaatggacattatttttcaaaaaaaaagaatgaagagtttgaacttaagattgaatgcattctacacaatctctacagtctcttccaattcttaacacttctctttctaaaactgttttctaaaatatttcattacataaaccccctggaaggccttctttgcatgcattcataccggttattatgtgcataaatagcagaaggttctgctttttaaaacagaaaaatggagaactaggtttgttgaagtttaatagctgtttttggtccgcgcaaattttcaatatcttggtgagctgcttcttagattaaaagatctagtattattgtagggtaggtcttttccaaaatgaaacatcatttgttctacattccttaagctaaaactaactgtatcattttagctagagagaagcatgcttcacaggtaacttttccttcgaaccatggatgtagttcagatttcgtttatattattccttgctttttacaagtgtaaaaagctatgaaaacttagatggttacttagcatattcattttatagtttgtgttatttaattgagttcatttgtacattcctgtcttttaaaaagtgggagatatatattttgctcttcactttggtttttgggtggattttgataaaacatttggggcagaaaaatgttcttgaaatagttacatagcttcaaggctatttcaaaattcaatacaatcagatatgtccatatacctaaaacattatttttacttttgtgaaatctagaacatatgcatcagccatctaaagacaatatttgaaaatccagtatggattaatgagctaaagagttttttttttttttttacaaaactataaaaatattcgaggaaagtaaaacaatgtttattttagaatctttggttaggtatgtcctttctagcaaggatgcaaaatatatcattataaaatatcgaaacagttcataataatatggtgggtgaaaacacacttcaaacaatgttctaacatatgtgatagctggagaaaattttcagctcagcaataagtcaaatcatatataaacggttcatatgaatcaataataaaaagcaaacttccccaagacttctagttgaaaaaaagtatataggtaagcaattcatgaaagcaaaaatacaaataaccaataaacattagaaaagttattgaatcttcttttaaatcagaaaaaaataacaaaatgcaatgctatcttcacataagattaaataataaaatatagatatacacaatgcagagatcagataatgtcttacttcattttgagataagataatgaacaatctcatacattgattacaggaatgtaacttagaaaagtctttgaagcacaattttgtctgtcacaatgtcaggtgcacattctttcaaccaattatttgtcatagatagttatcttaaaatttttgcacatatgagtgtttcttatggcgtaccttaaattagcgaacacaaaaccctaggaaaattctaaaagtccttcaatatgaaaatgactaaataaagcaaaatatgtctgcataaaatacgtggcacctatgagaagattgctttatatccatctacttgtcattgaaagacatattatcatgtattgttaaatgaaaatagcaaaatgcagaataacatattatttttataatgccctttaaatagatctggaaggacacatacccaactgttaatagtggttaccccattggaaggtagagacagaggcagagaaaaaaacttctgtttatatgacatgattctccaatagtttgaatttttttaaaacaaacctgttttacttttgaaataaaagactatttttgaagtatttaaaatcaaaatacatttattgctaattatttttacctacacttttaaaatatgaatagacaagagtaaatgaaggcaggaaaattgtttttatcagattagtaatatcaatgcaagagcaagtttttctgtgttttgaaaactgaaaaagcaatttatttcacttcctccaattatcatgggcacatatttctatggtctgaatgtgtctatgaaaatacctatgttgaaacgtaatccccaatgtactaatattaggaggtggcagtgtttgggaggtgatgaagtcacgaggatagggccctgaaaggaattaattaccttatgaaagggctagaaaaaactaggtatgcccttctgcccctctgttccttccactacctgtgaacacagcattcaaggtttcatcgtgaaagcagagaccaggatttcaacagacactgaaactgccagttccttgatcttaagacttcccatcctccagaactgtgagaaattaatttctatcatttataaataaaccaggctcagatattttggtaaaacagaacaaaaaagctaagtcatatatagaatggtagcaaatgggcagaaggtgtaacactctttgggtgaactctaaaatgggttagtcaagtaatcactttctccacatctttagtaacttttaaccttttttgtatggcagatctctaacattttattttttcctttgaaatctaaattgtattctaataataaaaaacaatattaagaaaaacatgccattatccttaattaccaaaagtcagatgcagtaaatatttggggaaaaatgtgccaacaaaactattttaggcagctgctattctgactactgcagagcttcctgacataacagtagtaaactcacacaccatcagatgtgatcaaaggtgtttttgaagagaggttctattccttttgtcttcaaatacattaccagatgaaggtcaaaatatctttaaaggggaaaatactttttccagctttattgaggtataattgacaaattgtatacaattaacaaaatgtatatatttaggatatatgatgtgatgttttgatataggtataccctgtgaaatcactaccataatcaagctaattaacatccatcatctcacaatgttaacatttgtgtgtgtgtgtgtgtgtgtgagatgtgagagcattaaatgtgagagagagcatctactctctcagcatatttcaagcatacaatatagtattagtaactacaggcaccatgctgcacatcagatctccagaacttactcatcctgcctaactgaaacttctttaccttttgagaaatatctctctaattttcacacccgatccccatcccatggcaaataccattctactttctgcttctacaaactcatcttttttagatttcatatataagtagaatcatgtagtttgttctttctattcctggattccttcatttagcataatgtcttcctgagtcattcatgttgttacatacaacaggatttctttcttcataaatagtatttcattgcatatgtgtgtgtgtctgtgtctgcatatgaatgccacattttcttttttatttatgtatttattttattttatttatttatttatttttttttgagacagagtcacgctctgtcgcccaggctggagtgcagtggcgcgatctcagctcactgcaagctccgcctcccgggttcacaccattctcctgccccagcctcctgagtagctgggactacaggtgccagccaccatgcctggctaattttttgtattcttagtagagacagggttcctcggcctcccaaagtgctgggattacaggtgtgagccaccacgcctgggcttcttttttatttttaaggcggggtctctattgcctgtgaaaaagtgcaatggggcaatcatagctcactgtagcttccacctcccaggtttgagccatccttctgcctgtgccttcagagtagctgagactacaggcttgtgttaccaagtccagctaatttttttgtttttcagtagagatgagttcttgctatattgtgtaggctggtctccaatccctgagctcaagtgatcgtcccacctcagcatcccaaaatgctgggaatataggcatccgccagtggcccacattttctttatccattcatctactgacaaacattaatgttgattctatatctggacaatcaacaccaacacatgaaatcagctgggaggggggctatgtcctggaaagccacaggggttgagctgcccaaggctgtgggagtgagacatggagtcaaaggttatcatttcagagctttatgatttgaccatccctctggatgtcagtcttgcatggggcttgtagaccctttgttttagccagcttctaccatttggaatgggtgtatttatgcaatgcctttattcccattgtatctagcaaataccggacttgcttttgattttacaggcttgtaagtagaaggcacttgctttgtctcagatgagactttggacttggacttttgggctaaggatggaatgagttaagactttaggagactgttgagaaagcatgatttgttttgaaatgtgaaagggacataagattttgggggagccagggggtgaaatgatatggttaggctttgtatccccatgcaaatctcattttgaattttaattcccataatccccaagtgtcaagggagagaccaggtggagataatggaatcatggggtggtttcccctatgctgttctcatgatagtgagtgagttctcatgagatctgttgattttataagtgtttggtagttcctccggtgttcattctccttcctgtcatcttgtgaataaggtatcttgcttctccttcgctctctgctatgatgataagtttcctgagactccgcagccacggtgaactgtgagtcaattaaacttcttttctttataaattacacagtcttgggcaatgctttatagcagtttgaaaatggactaatacagatacttttgtggggaagcattcttgtgataaatatgtatcatatataatgtatattgatgtattagtatacataaatacgtatcacaaatgactatacatatgtattttctaaatgtatctacacaaatagtagaatatgtgtatatacgtatgtgtgtgtgtgtgtatatagctacagataggtacatatactacatatatatatttgcctatatatacccatatgatatatatatatttatctactatgaaaacacacacacacacacatatatttacctacctatatgtagacatactgatatgtagaaatgtcaggagattgtattttaatataaatatgtcacctctgccgtactagaatgtgtaaagttgagcccattgttggtgggatagggaggttacagaaaggactactggtgggaaggtagtgggaatatactcacacaagggggtaaggcataaagtagtataagaactaacttcataatactgccaaagactgattctgtttgtcagtcagaataggatgtaaaagactatttcaaagagttaaattatttgttaatatcagagatcagccacagacaagaagtttatggatgagtgcagcagtggtccattggacatgttaaatacttatggatatccacaatttgaattgacattaaaaatgaatggatacccaactttgaattccatatcgtttttcatatcaaaaatattattttaactatttaaacattttaaaattattctcagctcatgggccattctaaaagaggcaaagggctataatttgacttatgccatatggtttactgatgcctggactagatcatttataataaatgaaaatgcctctcttgatcattatttcaaatttggtcaaagaaactgcatgatatcttaagtctgtatgtctttggtagttactatattctttaaaaagtatcagaacacattttctttttgaatggacacaagtacaagagcatcaataatgaaatcattttttattatagaatacagatattaaagccagacctatgtgtttcctagctgaataaaaatagtgtgctatgtatatataaatcaataggcttttcattagtgaaaataacgaaaaataacaaagctaaatcattatgaatttcttaaatgtataaagtccatttcaaaagaattttctaataaagaaagaacataaacaaagtgtaggtaagtttctttcacattaatctagcatccctcttctcaatatttgcctcagaggatgtcataggtaaataaaaaccatatgaatatccatgaaataagttgatagtgtgagagataacttctaaaactaactgtataggctttaaagaggcagctagatttcatttggaaggcaggcagagaaatatatcggtgaaatttaggtcataacttccaatgttaattaatttgcacctcaagcctactagaccagtggaattaggatatgatagaaatatgcaggatgtattaaggttttggccaatgggaatgacctgcttctcatattataaccttagcctagttaatttactgggaacaagttttaatgttacagtcagggttttaactcctcaggtgtcaaccctacattcagctgaaagaatagtatacacaaaagaaataggttaatttgtttactgtgctagaggatgcagaggcttctattagcctccaaccttacaggcttctcacacagttcatttaatattgaataaatataactttaagttatagtcatcaaaactatacatttcatcttctttgtatggaaaatataaaattaagggaggacattttaaattttctgtaccctacatgggagaactaatttgcctgctcatggaagacaaaaagaaaatttaatgtcacttctgccatacgagaatgtgtatgttgagaaggaatcagggatgctcatccctagaatatcttggtcattgatttgtccacttcttagagggcccatggataattcaatgatatgtacactctaaatattcacttaatatgttcaaggtaatttaaacgctgcatttcacatttatgagaaaacaggatataaacgcctacgcaagtccaataaacagatctcagatttaacctcgaagaatgctcagtatagcagaaaaagggctgcaatataagctccatgagggcagtgatgctgccttaatgaatattttattcccagtggcctgcacattccctgacacaaagtagacacacaataaatattttcagaagaaatgttaaatcattgaatccgtaatatacaaaattattataaataattaacaacatactatataacaatagcaaaacaaaggtaaagtacattaacagatgatttataaaatacatatgaatggcaaataaataaaaagtagaaataaaccaatatatgccattgcattttgtccactggattggtatctttatagcattgacaatttcccagtgttggtgaggtaattaaaaagctatcattcttgggacagtttgggggcatataaatttttaaaaccattgtgtacagcattttaatcaatggcttaagatgaaaatagaaatctattatgtcattaaacagcattgatggatcttgtaaacaggagagtaaaaaaagcaggcagaaaagaatatatactgtatgactccatgtaaatttaaaaaactggagaaactaagctattctaagttgtcaggagtcaaaatagtaattatatttagggaggaaagattattgattgggaggcagagtgagtgaggctagtaatgttccattgatctggatgtgattattaatacatggtatgttcaatttgtgaaagttcatcaagctgtacattaatgatttgtgtacttttccaggtatatgctataccgtaatgaaaagtttatttttaaaatgcttataaatatttttgttcagctggtcaaaatacagcgtgaacaaaattatagtcgtatagttaccaaaatatactctttctagtaagtcaacaataagcaaaggaaagattttatacttgtatatgcatgcatgcacatacacacatgtgaaatattttctgaatagattcccacttaatgtcagtccgtttggctttgagctatatagctgacccacatcagctgctttcaaacagattgaagtgatgtgtctgaaggtgacaaaagatggttgaggtcatccttttacaaaggcccttaagtaatcagccaccagaactgccataatgcattattaaaattgcaaggcatctctgcaagtttgagccatgtgtatgagggcacacagaaatgaagtctccttgctcataaacatcctttgcacatatagaaatgtatttccctgccctgattattgccctttaatgaaaacagacagaactggaaaaaaatgcactgtttttagctgtgtggacactgtgcaatcatttggactgggcagtgcaacagtcggttatctaggccagaaacaaagaatgaaattaagaatcaatctctacttacatgaaagattttttccaatgtagtgtgatgcttggagttttgttaactgtatgggttctgaacttctgttttaaagtttcccctttcaaaagcacatccaaaagactctttcatcacaactataaacagaaactaggccagtactggcatacatatatgtttgtttgttttttttctttctaaaattgtgacaatttttcacttaagaggtattttcctttctttattttatggcaacaaagtatttataaacctcctattttctgttttagtagtaaattagccttggcatgaatatgaagtaaaaaataagtcctattaattatgaaaaatggagttataggatttagctaataacatattaaaaccatcttttcacacctttcctaaagacaaaaataagactaattagtttcatgattatagcattaaaagactctatctatctgtctttctacttttctcctctttccggctagtttaatctaaagaatatttctttcttttcttttcttttttttttcgagacagagtctcgctctgtcgcccaggctggagtgcagtggcgcgatctcggatcactgcaacttccgcctcccaggttcacgccattctcctgcctcagcctccccagtagctgggactacaggcgcccaccaccactcctggctaattttttgtatttttagtagagacggggtttcaccgtgttagtcaggatggtctcgatctcctgacctcgtgatccgccctcctcggcctcccaaagtgctgggattacaggcgtgagccaccgcgcccagacaataacatttctaatttattattcctgaagtcatttataacccagagactacttacatatgttctcaccaatgaaattactccctttattttcacactgaaaggacaaattcatccctgttttcatctttactttttttttattttcataattacaaccttacgtaaaactttgattagaatgaaaaatgtaattttaataggacacctgtatttcatattaactaaggctgggcaagactaaaattctacttatgtctttcccctttacacactttcaattgctttttggataatgttctttactagtgaaaaaagatacatggtataaatatactcatttatgaagatttctctagtgatgatgtgaagatatcactgaagttgaagcttttcccagataaaataggatgaccattgagttaatgaagttttaagagctgagaaccttcaactaggaactggatattagcagcaacgcaggagctcaagagctcaggttttgattatgagataaaactggtcttaaattctagagcaaccatttgagtaatcttgggcaaattagtgatttccaaattcacaaggctaaaacagaactcttgctcccccaaccccaacctggtcttcctttattcttccccatgtcaattagaggcggcatcaccacatattcagtgatcacgccaaaaatctaagctattttttattttatttttctcttttactcactacacattcaatcattagcatctccgagtgtgtttctctctctctccttttctttctaccattgctatccacacacaaaccaccatcatataatgcttgaattatttcaagaacttcctaattttcctccatacaattcattcaacaaacagcatccagagtgttattttttaatataaattgtcatttactcccctgcttataactctctagtgattcttcatcataaattaaacatttaaatccctccaccaggctcacaatgacctgtatgatcttgccctacttatatattcagtttctttctataacattctccttcttacccattatgatctagctcctttagttctatctgtaatgttcatcctttttgtccttcagacttcatcttaaatgttaccttgatctcaccagtctaaaggagacaccaagttactaaaataatataaacttgtattattgctttttgttttatttacttctatactttctgtatctggcacataaaatgtgttccttaaatatttgctgaatgaatgaatgaacttaaaggaaaaaaaatttgttactgtaatgcagataattctacctacctgtcaggcttggactagaagataaatgaggcaagataagttgagtgtttagcacagtacctggggcaaaataagacttcgtaaatgattgccacttgtgtttttgttaaaacagggactacaataaggtcttacaaaggacttcttattgagtaataatatctctcctaagtgtaagattctaaggacttttttccagtggaaattattaaaatataggggttttatatgggctagtgaatgaattattgaatgaatgatgttcagcattttaagctaacctgaatcatactattgctgatgtatgtaacacacctttattccttatttctttaccatcctgagattctaaagactaccatatttaactttcctatgtatcagaagaaacctgaaaattataaactagaaggattcgacaaaacaaagaagcagtttgggatttaaagagatctaggaatacgttatttctaccacttgctgatgagcttcagataaccacctatatatgctgagcctcaattttcttacgccacttctttacagacttattggaaacgatgaataagatactgaatgtaattaatttagcacaatgatttagcaggtgactgatattcaattaatagtacattttctccaagtgtgtcactgagaaatagatctaaaaaaagctcaggaattctgttcttgtgttaatatgtgagcttaggctgatttcaatgttgtttaggctttcttgtatttctttaccctgttcttggaggtgccagtgtggccatgctgcctactaggttttcttctcatatactcagtttcactggtgctatgtgcaactacactatttttgtaagtggtagtaatttctttgaaacacaaagccaaaattaataagtagtgacagcttataggggtgaagtaatcatttttaaaaaggtcttggcagttggtttcttgaataagaaatgcacttgtttccataaattggcaacaaaaactgaaacacagaatgctgcccagaatcttgagaaatttgtacttgaattattgttatggtccattaaactcactctaaaaactttaatatgtttctgcttcagagacttgtttgtccatgtacagccatgtaaccacactatttacaatgcccaaagagcaaattgtttgattcagctgcagcaatggtctttccacagagaaagtttgcagttttcaacagccctaagtgctgcattctcctaactgaggtaaatactctgcattgttttcttcccaggtgattcaagctgcaagatagatgactaggactcaaataccggaaaagagaggtaagtaaactgtgttatttgtctaagttttagacaaagtgtgttcatcagaagcagagttaaagtaagagtttgaacaatagttttaaaaagtattcagttttcccagctagcactgttcagcatgtgatttcattatcctctttgccccattcagtttgaaacatttttatacttcagatcatttgtaacagatcatcactcagatctaatacataagacacaggaatttatattgaaaataatgtgtgcaacaatacttagttcctaaagaggacctaaggaagcagtcacagtttgtcatatacatcagtgacctttcaaggccgggacctcagtttgctagatgggctattattggacagagagagccaagacagaaatgataatatatatgaccagttctaggcaattcttagttaaaaatataagaggatgggactggaggccattatccttagcaaactaacagatgaacagaaaaccaaacaccacatgttctctgttataagtgggagctaaatgatgagaacacatagatacacaaagaagaacaacacacactaggacctttcggagggtggagggtgggaagagggagaggatcaggaaaaacaactaatggttacgaggcttaatacctaggtgatgaaataatctgtacaacaaacccccatgacacaagtttacctgtgtaacaagcctgcacttgtacctctgaacttaaaatcaaagttataaaaaccagtggaaggtaaagtgcaagaaatgtctaaaaatttatttggatatatgtgtcaaaaactttgaaagagttcaaacattacatctgtttagtacttccattattaggagtttattctaaagaaagctgcagaaaatacgacaatgctcaaaacaaacatcctacataaaaacaattttaaactatataacataaaaatgtatatatgtacatagataggaataacaatatataatgtgttaatgatgattaccactaactataaaattatgagtggtttaattatcttagtcaaattttgaggtataattaagtaagtcatattttcaatgaatttgacatatagagtcataccataacaagatacaggtcatttctgtctttccaaaatgttttctcctacccctttgcaacagctccacagaactttttctccaagtgtgtcaccgagaaatagtcctgaaagcagaataccccaactggcacaagagaaccactgatttgcttcctgtcaccacaggttagttttacattttctagaattgtatataaatagaatatactcatatatatggattattttattccaaatgttcctgagatatataaatgtcattggttttttggcatggtgtcttttaactcagcaagtttctgagatttatcagtgtttttgcacatattaataaaggcatactatgaagatactatgtattctgttccagaccaccttaataaagcaaatattgcaataaagtaacaggaatttttttgtttcccagtgcatatgaaagttatgtttacactataatattgtatatatattaagtgtgtcacagcattctgtctaaaaatgtatatacctttattaaaaatactttattgctaaaaaatgctaatgatcacctgacactgagacacaaaacaagcatgagcacacactgctgaaaaaatgtgccaagacttgctccatgcaagcgttaccacaaacctagttattccgttactaggaatttattcttttttaatttttaatttttgtcggtacttactaggtgcatatatgtatggggtacatgaggtactttgatacaggcatgaaatgcataataatcatagcaaatgaggtatccatcctctcaactgtgttacaaacaacccagttatattattttagttattttaaaatctacaattaaactattattgactatagttacccagttgtgctatcagatactaggtcttattcatcctttcaaactaatttttgaacctattaaccatcccaacttcctcctaatcccccaataccctccccagcctctggtaaccatccttctactctctctgtccatttacttgtttttattttttattttaattttaattaatattaaaattgtttgttttatttttttggttcccaaaaataagtgagaacttacaatgtttgtctttctgtgtctggcttatttcacttaacataatgatctccagttccatgtatgttgttgcaaaagactggatctcattatttatttgtaactgaatagtgctccattgtgcatatgtaccacattttctttatccattcatctgttgatggacacttaggttgcttccaaatcttagctattgtaaacagtgctgcaacaaacacaggagtgcagacatctcttagatatacagatttcctttcttttgggattgctggatcatatggcagctctatttttttttttttttagttttttgaggaagctccaaactattctccatagtggttgtactaatttacatttccaccaccagtatacaaatgtttccttttctccacatcctcatcagcattgattattgcctgtcatttgtatatatgccattttaactggggtgagatgatatctcattgcagtattgatttgtatttctctgatgatagatgatgtcaagcaccttattataggtctgcttgccatttgtatgtcttattttgagaaatgtctattcaaatcttttgcccatttttaaattagattattagatttttttcctacagagttgtttttgctccttgtatattctggttattaatcccttttcagatgcgtagtttgcaaatattttatcccactctgtgggctgtctcttcactttgttgattgattccttttttgtgaagaagctttttaacttgatgtgatcccatttgtccatttttgcttttgttgtttgtgcttgtggggtattactgaagaaatttttgcccagaccaatgtcctgtagagtttccccaaagttttcatgtaatactttcatgatttgagaactaaaatataaggttttaatccattttgatttgatttttgtatatggagagagataaggttctaatttcattcttctgcatatggatatccagttttccaatcatcatttattgaagagactgtcttttccccagtgtatgttcttggcacctttgtcaaatacgagttcactttaggtgtgtgaattttcttcttgggggttctctattctgttctattggtctaagtgtctgtttctatgtcagtaccatgctgttttggttagtatagctctgtagtgtaatttaaagttaggtattgtaattcctcccgttttgttctttttgcttaggatagctttggctattctgggtcttttgtgcttccatataaatttcaggatttttttttctatttctttgaagaatgtcattggtattttgataggaattgcattgaatgtatagattgctttgagaaatatggacattttaacaacattcattcttccaatctatgaacgtggaaaatcattccattttttgtatcctcttcaatttctttcatcagtgttttatagttttcattgtaaaaatctttcacttctttgattaatttctaggtctttaattttatgtatggggattacttattaaatttctttttcacattgttcattgttggcaaatagaaatgctactgctttgtaggttgatttgtatcttgcaactttcctgaatttgttttccagttctaatattttttgttagagtctttagatttttctaaatataagctcatattatctacaaacaaggataatttgacttctccctttccaatttgaatgtcctttatttctttctcttgcctgattgatctagctaggaattctagtattatgttgaaaaacagtagtgaaatgggtatccttgttgtatttctgatcttagaggaaaagcttttagtttttacccattcagtatgatactagctgtgcatctgtcatgtacagcttttttttatattggggtgtgttttttctatatctagttttgggcggattttatcaagaagaaatgttgaattttatcaaatgagtgttcagcattaattgatcatatgctttttgtccttcattctgtttatatgatagtccatattgattgatttgcgtatgttaagacatccttgcataccttgagtaaatcccacttggtcatggtaaatgatctttttaaaagtattgttgaatttggtttgcttagtattttatcgaggattttttcattgatattcatcagagatattagcctgtagttttctttttttttaatgtgtcttttcctgtttttggtatcagggtagtattggccttgtagaatgagttttagaagtattctctccacctctacttttttttgaaatagtttgagtaggattggtattagtctagaaatgtcatctgggaactagggcctagaatggggtccttatggcttgtctggtgcccttactctactgtggctgagctgatatccagtgtaagacaaagcattctttactgttcactctcctctcctcaagcagaaggaaggagttacttttgttgctgccagctgcattgcctggggttaagggagaggttggacaagcactcctttatccaccccagctggtgtctccctagatcacatgccatcctagtcccctggctcgaagaccagcccagcactagaagttgcctaggaatttcagaccttgtgttctagacttcctttcaagtgtatctaggaccccagagccctttagcttgtggtggtgaggcttgccaaagctcaagttctgaccattgagataggttattccctcttggttagggctggtccaaatgctccttctgtagatgagtgccagccaaacccagcatagctttactttctgcgtgacaggatagcactgagttcaatgccaagtccctaagtcactgtgttctccctctcccaagtgcacagattctctctccaagccatgtggccactgccaggagatgggggagaggtgacataggcagttcaagactgtctttgctacactcttcaatgtctctttcagtgatgtggcattaaaccagttactatgattgctcacctgatttttggttgctatgatggtacttttttgtgtgtacatagttcttaaattttggtgttcctgcagggggaattattggttgaggcttctgtttggccatcttgctccacatctctatgagtatgttctctaaatgaaatttaatttatataaaaaagtaatatttgtaaagcacagtaaaatgaggtatgcccatttttttcctttttattgttaagtagtatttcattatggttatactaaaatttgttcatttatttattcctgaacatttgggttgtttccagtttttgaaaattataaagaaagatattaatgtagttattctagtctctcttagtcactgtttgcatcgtatagctttctctaacatttagcttttgaactttgtgttttttcatttgaaagatataatttaatcttaaaaaatatatatctacacaagtatttgtgaagacatacactttgagttttcttgggtaaataccgaataggaaaattatttacaagtgtgtatgtttgactttactaaaacaaaacaaaacaaaacaaaaaaaactacaaattgtcttcaaagtggtggcaacatttgagaattccgcttgcttcacaaatgccaaaatttgtattctcattcttttaaattgtaaccattttagttgttgcacagttttatctcactgtctttaactctcactgccctgatgactaatatgttgagtaccttttcatgtgcttgttagccattatcactttttgtatgaaatgaatatccaaatattttacacattttcttaaattgggctatttgtcttcatattgttgagttgtaaatgtcctttatatattctggagataagtattgtaattttttccaatttggggtttgcattttcatttcattaataaagtattctttaaggaaaaaaatgtttacttttaataaagtccaatgtgtcaatatgtttccttcatgatttgtgctttgaaaactgtctaaaatatctttgtccactccccactcataaagatttttctcttatatccactttaatttttgttagtagtacaaattaaagtttgaggttcattcttttatacagatacctagtttaagcatcatttgttcaaaaactttccttcttaatgaaacattttggcacctttgtcaataatcaatgactatttctgtatgggtgtcatgccaacaccacactatcttttcaacgttttttctctctctgttctccaatttagatagttcctagtggcatttattcagcttcactgattgtttttttctacattgttttctctgatctatatcccacctagtaaatgtttttttcagctctaaaaattctattgtgtgtgtgtgtgtgtgtcttccattatctcttcattattttcatgctttgaaaaaaatattgagcatgtttatagtagccattttacagcctttgtttgctaatctaataatatctgtcatttctgaatcttttttattagctgatgcatttctcctgggctacatcacattttcctgctttttttatttctagtaattttttttaacggttgtttttgagtttgtgtatttttttaagtactgaactttgttctgataggcaattaataaattttggataaattttatcttttcaaggctgacgtaggtgtagcccttactctagggattgtttagctctgatgcaaagatgaaacatttctgtactttctacaagatgttccaggtatttatgaaggtctctctattctgattggacagagatataatacgttttaatgttgagcagactcagtgattatgtaccttacagctctccaatagacctccaatagacaaataatattgtatagaattctccatagtttactttctggcaacaaagtccagggacccctatgtagattttgggagttctttccttacttaccatctgctctgcaaattctacctgacttaccttcctatgcttcaatgtctgttttctcaactgatctcctaatggtccccttttctgcactaaaatatggaaaatgcctccagacagaaagccaagatcactataggtctcatcttatttccattctcttctaaatcaccatcttgtgttgcttattgtttaatgtcagaaatcaaatgtgtcatatattttgacaagttttctggctgtttaaggtagggaaaacaagtctagtttcagttacacaaactgagagttcttaattatattttatataagtctcttttttcaaaattgtctataatgtgcataaaaataattgtgtaattaaaaatatgcacataataatccattggtcattctgcatcttttcccaaagtaaagatgatagtacaagctaatgagataaaataccaagcattttattttccctgttgttattaggcattagaaattttgaccttggagagctatattttaaatttttatataactatggcagaaagaaaaaagtttttacctatgcttacttgtgtggtcaaaatcattattgtctgctctctgtttctatctcaataataccattcttcatggctgtagcatagtttttatttgtggagttatgaaaaatgcaggctggtcacccaagcagaaaaaagaacgttgtcttcaaagccaaatccccagtgtacagaagaatcatctcaaaaccatgcagcagatttcagtacaattcacagctactgacattttatggaccaggaagatccaagcttaactagcatagaaaaagtaatacatttccttccttttgtagaaagctgcatataatatatctttgaagacagggttaagattatcaccatgttcttctatggataaatacaggagttcagtttctgaggctgtgtcagagtttgcagacaataaattcacataacagta

SEQ ID NO: 462 - DNA, 7380 bp, Homo sapiens
ttgaaatagtttaatagaggtagggttttaggtgatttaaaatttccagtgttctaaaataacaatattttaaaattatgttctgcttttatccaaattatatgctcatgcttaaaaagttatataattcagtggttgtacacaaaagccacagactactcttattacatactttttcctgcttctcagaggcaaccactttcaaatagtttgcatgattctatttttatttatatgcaaatttctctgcaatatgattatattgctacttcttaatttatttggatggggaagggatgatttagacactgtatattgacattctattttggaagatacaaatcaagcctttttcaacaccactttggcagaccttgctctctgacacacgtgtgtcctcagcctctcatcattatgtcatatcatggtttggttgcatatgcaatttttacattgccatattgatataagcactatttacaggatacacatgtcagacattacttctactcttccttttataaaaatattaatcctttttattttttcagtttattgtacgatttttaaattgtgtggttttgttgccattgctttctgtgttttagtaataatcgctaactgtcatttaatcctttgcccccatatcccatatatcacttttgttaatacatgtaaatatacaagaaattataaatttaccttgttaaatcaagccctcctgataaatctcatcctgctgcaaattaccctgggtgtttctccagacctgcctacagctgtcaccttgtgatgggtgattccctctacctttcttctagattggatgccctattccctagatttcttgtcctctttcttggtttaccagctaaaacatcttccagtaacattaagaaaataactgcacgggagataaaagtcttaaatactttgttgcatacttagccatagaaccctagattataactcatactgtctcatcagaatcacgaacacttggtcttattgtttactagcttatttcatattaatgttccctccaaaagcttaaatatttcctttctttgtatccagggtactgacttttcaatgatgtgtcttaagatggatctattgctattcataggactgggaacatggtcacatggtgagtctattcattataaaagcatatgtctttccattctgggaactttttatgatttttttttttcatgaattcctatgctatattttctgttttctccttccgggatttctatgttttaagacgttggattttctctgtgggttccctaattttattttattttatttctattcttattttttcctaatttcaatcttagacattttgcttttcattctggaacagcttttcaactttaccccctaaaactttcattgtatttttccatttacactatcttagtttccaacattaaaaaaaaaaaaatctgtgttcttgttttcgagatgaagaaccttttctcacatctttgaggatattaatcccagatattttgaagctttcttttggtgaaaacttttctccgagttattgtttgtttgttttagtctctttggtataacatgctttcttcaaatatctaataatccttgggattctgctataaaagcagagcacctctcctcctccaaaggaacgcagctcctcaccagcaacggaacaaagctggatggagaatgactttgacaagctgagagaagaaggcttcagacgatcaaattactctgagctaagggaggacattcaaaccaaagacaaagaagttgaaaactttgaaaaaaatgtagaagaatgtgtaactagaataaccaatacagagaagtgcttaaaggagctgatggagctgaaaaccaaggctcgagaactacgtgaagaatgcagaagcctcaggagccgatgtgatcaattggaagaaagggtatcagcaatggaagatgaaatgaatgaaatgaagtgagaagggaagtttagagaaaaaagaataaaaagaaacgagcaaagtctccaagaaatatgggactatgtgaaaagaccaaatctacgtctgattggtgtacctggaagtgatggggagaatggaaccaagttggaaaacactctgcaggatattatccaggagaacttcctcaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagactgggggccgatattcaacattcttgaagaaaagaattttcgacccagaatttcatatccagccaaactaagcttcataagtgaaggagaaataaaatactttacagacaagcaaatgctgagagattttgtcaccaccaggcctgccctaaaagagctgctgaaggaagcgctaaacttagaaaggaacaactggtaccagccgctgcaaaagcatgccaaaatgtaaagaacatcgagactaggaagaaactgcatcaactaacgagcaaaatcaccagctaacatcataatgacaggatcaaattcacacataaccatattaactttaaacgtaaatggactaaatgctccaattaaaagacacagactggcaaattggatcaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaactgactttaaaccaacaaagatcaaaagagacaaagaaggccattacataatggtagagggatcaattcaacaagaagagctaactatcctaaatatatatgcacccaatacaggagcacccagactcataaagcaagtcctgagtgacctacaaagagacttagactcccacacattaataatgggagactctaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaacaatctctcagaccacagtgcaaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcccacaagagaaagcaggaaggatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaatagagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagcagttgaatctctgaatagaccaataacaggatctgaaattgtggcaataatcaatagcttaccaaccaataagagtccaggaccagatggattcacagccgacttctaccagaggtacaaggaggaactggtaccattccttctgaaactattccaatcaatagaaaaagagggaatcctccctaactcattttatgaggccagcatcattctgataccaaagccgggccgagacacaaccaaaaaagcgaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatataagcaaatcaataaatgtaatccagcatataaacagaaccaaagacaaaaaccacgattatctcaatagatgcagaaaaggcctttgacaaaattcaacagcccttcatgctaaaaactctcaataaattaggtattgatgggacatatttcaaaataatatgagctatctatgacaaaccgacagccaatatcatactgaatgggcaaaaactggaagcattccctctgaaaatgggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaattcacaagcattcttatacaccaacaacagacaaacagagagccaaatcattagtgaactcccactcacaattgcttcaaagagaataaaatacctaggaatccaacttacaagggatgtgaaggacctcttcaaagagaacgacaaaccactgctcaacgacataaaagaggatacaaacaaatggaagaatattccatgctcatgggtaggaagaatcaatatcgtgaaaatggccatactgcctaaggtcatttacagattcaatgccatccccatcaagctaccaatgactttcttcacagaattggaaaaaactactttaaagttcatatggaaccaaaaaagagcccgcatctccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgaaaaacctgagaaaaacaagcaatggggaaaggattgcctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaagacaaaattgacaaatgggatctaattaaactgaagagcttctgcacagcaaaagaaattaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaaagaagacatttatgcagccaacagacacatgaaaaaatgctcatcatcactggccatcagagaaatgcaaatcaaaaccacaatgagataccatctcacaccagttagaatggcgatcattaaaaagtcagaaaacgacaggtgctggagaggatgtggagaaataggaacacttttacactgttggtgcgactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaaaatgatagactggattaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccacgtattctcactcatatgtgggaattgaacaatgagatcacatggacacaggaaggggaacatcacactctggggactgtggtggggtggggggaggggggagggatagcattgggagatatacctaatgctagatgacgagttagtgggtgcagcacaccagcatggcacatgtatatgtatgtaactaagctgcacaatgtgcacatgtaccctaaaacttaaagtataataaaaataaaaatagaataaaaccaaaaaaaaaaaacaatgggtctgttgaacccatttttcactatgatctagctgatttcgttctacttaagggttttctgctgccatttttgttaggtcttttctcttgagtaagacatattccctacagaagattcatacattttcctgctcggatgaaacttggctgcctgggttctgctgtagatctcaataagaggggagagtcaggcagggtgaagtgtttcagcgtttagtatgcatattcctcctttcagttttgtattcctatcctgtgtccacgtgtcctccaggccagagaacctgttttatcctctttggggaataaagttcttcttttctagtagggggagtgaagagtagtagccttattttgaagaacaggaaaagcaacacagaagtctaactgttcaagagactccaaactacttttatggtatttagccataatttcatctcttttggcaaaagtccctggtgggacaaatcttaaattttacaaaagagtatcgtaatgaacactggggggctttttaactttctgcactgtcattttagcagaaagaaagaaagaaaaaagctgaatcttacttacctagtttccagcttcaaaaatgtttcatttgtgatctttcaattttgcttttgagc

SEQ ID NO: 463 - DNA, 24850 bp, Homo sapiens
atatgagacttcaaaatcacccaaatgtctttagcagatttaacaagcctctgactttcccacttacaagttgatcagtccaataaatgtctatttaaacttatgttttacttagcttataaccaaattctcataaatttcctttataccttaatgtagaatagcatatctctggaaccaagagaaagttttaaggtctacttgttacccctttttcaatggctttaaaatattttattcataattagaaagacagttctggattatcaagcgcaagatctcttcatttacgccttgtgaataagtttgacacatttatgtagagcactgaataatttagtgaactgagaccacttgggactgagcaacactcgtatttggactgcctcagaatttttatgaattttgagtttaagcccagaaacagtgacaaaaaagtgttaacaaaaaaaggtatatgaatgtataaaaaaatctccttactttttctatatttagtgtgggtctacatgctttttaaataaccctgaacacaaaacacttaagaatgcttgaaagattgtagaacattcattttaaataaaacatatttccttgcttttaatcaatctaaaagtaggtgttgcttcattaatttcaaacacattaggtattagaatgtgaaaggagggggttagaaggcacctgatgacatacttaagtttaataagatcttgattgtgatgttaaatcataaaaacaagcaattatgaatctaacaaaaagtattttaggctggacacagtggctcacacctgtaataccagcactttggaaggccgaggcaagcggatcacttgaggtcaggagtttgagaccaacctggccaacatggcaaaaccctgtctactaaaaatacaaaaattagctgggcatgctggcgtctacctgtagtcccagctgctctggaagctgaggcacaagtatcatttgaacccggaaggcagaggttgcagtgaaccaaaatcaagccactgcactccagtctgggcgacaggaataaaaaccaatctcaaaaaaaaatacaaataaaaaacaaaaataaataataattgctcaaactataatggcataattttgaagacctcatttttatggaatagagttgccagttctgtaatctgagacttcataaattaaaaactactgtatctggaaatcatacctgtaatgcagtgacagctctcttgactttcacttagttggtgctggttaacagtatcttttccctggcctttgtaacccacactgactgatataccaggtacaccgaaccctctctgttgttgattactcactcatgttcatgacttctgttgatcaatgaggccttcaatcaacaaaaacaattgcatttgcaaaggacctaccatggagtccagagtgggcattcccacccatgttagtatctttctctttctttctctctgttaaaaagtcagaagctgttacaacaagaagaatagcaaaatgcattactagcatcatattaaaaatgccataaggcaatatatgtgagtacactgaatataaaaataaaaataaaatactattatatgatattatgttatatattatattatatactctactatattctattattataataagaaagcacaacaaacaaagaatacctaaaatataaaattaggaattccatgggtctcttgtttttgaattgggggaacttaaacggtcatctaatctcaatccttttaattgccaaattagaaaacggactcagaggagttaatatctatagattacttattttggaagaggtactatgttaattatgttatatatattctttatagtcattgtcaaagcaaccctaaaacaattattatttgcatttgagaattattctctgcactttacagatgagcaagggaggcttgctaagggtttttagctgcagagattaaaatcacttctaacttacacccaaactcactttttcctgccttacatcatattgtataaagggaccgataaggattttaactgaactgaggggaggcagacaaggtagtgattcatttatgttagctttaattaagaagagttccatgataaacccaaagactttagaggccagtcaggagacctaaatatgtgaaggagtaatgattactaaagagcattgtgaatttctacctaaagacatttctgttcaatttttaaaatatgaactggcccaattaaaatatatctgctggatggttacccatttgcaacttatgaaagagagcaaaggtaagggatctgcaaaaataagtctggaaaacatcctaggcttgggatggaggcactataatatatgggaaggtacaataaacagatgaacaattaaagaatcaggggctggctggtcttaaccatatcaaagaagtatgtatttagttattccatatatatagggagggcagacttggtagtacaagtgaaaggagaggaaaaagagggggggaacttttagtggtccttaggtgctagcctgggtatttgtattttattagaatgaagaaaggacccacttagaaatatgccaaatacttccctattgtattctaggtatacttactgtatattgtgcctttggaaaagcctttacattttacagattggttcactaatatttattgaagataaataacttcctcaatgtcataaggtagaaagtgggtgagtaaacttttaaattgtatctgtctggttcctgaaagaatccacacaacattataccatacagttttctgtagaaaatactcacttttatattctatgtcactactactctaagtattcttcacatattagctaattttatcttcataaggcacagaaagacaaatacttcatgatctcacttatatgtggactctaaagaagttgaaccagtggtactctttaccaagagtaaaatatgctgataaattaagggaggtgtgaaaaagaaaaaaggcctttagatcgattagttttcttttaatataaataggttttggtagtgtaggggtagacagacaggacagctttcctcacccatcataaggatcatagctgacactactatagcaaaaggcaggttaataagagaagagcattaaaaaaatatttaatcagttctatgtgacatgggagccttcagcaatgtagaccaaattaggttagatgaaggataaacagccatgcaaaaatgtgattggacaaaaagggaatgatctaatggtaatagactgagtgagggaactcagcaaggcttgtttgttcagattcttcttaaactctctgtgtagtatttttctcctgagtatagggcaggacccattctgaaatgagggtcttatgatctattattagacaagctgggtcaaacaatttcattacagccagctcctacacagaaaggtggaaaaaggttaaagtaatatttctaggttttatggctggcttttggggaaagtagttctggaattctagtttctgtggcctgccttgagggagaaaagggagcaggagaaagaagggcaagagaatgtcagaaagagactctgtttctgacacccttctgagacccttccaatgtccttcagttcaaactactcagcattccaaaatgccacactctggggtatcattttctgaaccccaatagtagatcagttaaattagagaagtagaatgataatgaggacaaatctctgtgaccgaactctcaaagtcttttaacctttcccctaagttgcattgaaagtcttaccctctaattcccatcaattatttcagaactgcaggaaaaattgactgggaaaagttggtgggacaaattgaatccatcaaataattccaagtgaaatactagaaaaaggaaggtgggcattgtgatcctgagacactaaacatgtctccatttgttctatatcaatattccactgctttttgccagcatctgaagttacgttgtttaccagctagtttatttgtgaaatcgagtattctccctgtattactactatgtgaaaagggtacaaagcaggcatacatctttttctataaccgtcctttcatttttttcacaagttttagtagatacatttacagaaacccttatatgtaaagaagtcttagtaatgtgatttaatgaaaacacttaatttgggaagagaccctttaaaatgttccatttgcatctctctgatataaatttcaatatcaaaattccatcaacagcaggggaaaaactgccattaactagagatagcaactttgctcttaatagaaacactaaattactgctctaagagctaaactacatataaaacaactttagttctttaagaaagggtgagcaacattttattttcgaaaggaacatatgttattttcatttgccttaaatgacacatggaaattaagaagcctaccattaaataggcaaacgatttacaagaaatgaaatacagtgctaacaaaagttcaaatggatctggtttcaagatttgaaaatggaatattactcataataaaaaggaaaggagtaggaaactgggcttagtgcccattaagaaggtaaacttgagaatgacaaaaggctgaacatatacagagtgaatggtgaatacaaagctgaaaccaatgtcttcatctgtattgcctttgaagaaaatagggggaagagcataggtaagtttctaagttgttatacaaatttcagtaaaatagtcaatattagtattttatggtacttttggttacaagtaacaaaatcagactctggctaccttatgcccaaaagaaaatttattagaagaagctagagtatataacagaatgcagtgaaaatccacccaaggaagctatggaaaagcaggaacctggagagctcacagatcctccctagagatgttaaggaaactttcctttaaggaaccgtaataagcctgccagagtttcaagaagttcaaatccttttatcactcaaatatcaactttatattaaagttaggtgtccattctttgatcagccaaatgcatctaagggactgttacgtaggataaatgaagcaactggggcttacacctgtttgaggggatattcccatagtagacaaggttttgaactggcatttcctactacacagtaaacgtagttacactaatgaaaaataaaaacaaaagttgatacctgaacaccacattacatttatcattcaagaattatttggggccgggtgtggtggctcatgcctgtaatcccagtactttgggaggccgagacgggtggttcacgagggcaagagattgaggccatcctggccaacatggtgaaaccctgtctctactaaaaatacaaaaattagccaggtgtgctggtaggcacttgtagtctcagctactcgggaggctgaggcaggaaaatcacttgaatccaggaggcagaggttgcactgagccgagattgagccactgcactccagcctggcaacagagcgagactccatctcaaaaaaaaaaaaaaaaaaaaaaaaaaaatatttgattctatataatagtaacatagaagaaaaaatgcaattgtgtattaactacctcagggagttactataaaaatgtagacacatgaagttgttaccacttcgtttaacaacttcacccaagggatattaactttattcttaaatacatttattcattttacatatttattttgtataaattgggtaatattccaaaaatgtagaaaagttcagaatataataaaacaaatgtctgctttcactgtatagatataatacatattttatactgcaaaacattaacctgtacacagttctgaaatattaacctgtatacagttctttcagatattatttttaatgacatacaattgcttcagatgtaataaaaccattattttctctctacaggttaactattttccatcattttgaattattcacacacacctaggtaaccataaacaatacatatcattgttgtgtgtgtttaaatcttacataaatattatcttactgtcagtatccatccccaactggtttttatgaagcaacaacatatttttcagtttgagtcatgttaatgaacgcagttttagttcattaatttaaaatgctaaacggaatttcattcatctatattgatgaatattgaggttgtttatttccttatttcttgcctgtctaactaaaggaatgatgcaataaacattgtggtagggagctgactgagcatgtgctcagtggtttacgtagggtttaaagttaaaaatggaattgttattatacaagacttgttcatctatgcttttactagatattttctccagaatagttgtaccagtttacagttgcagtagcagtgtatgaaagctgccactgaactatgtccttaccaataatgggtattatcatgtgtaatattttagtatttttttttactaatagtagtatctttttaaatgatagtcacagaatagttttaacatattcattgtctattttccttttatctatttacctttttctattaaagtattaatttttacatataacagataaattttatttgtcaattatggctatttcaaacatattcatccattttgttttttatttttttctcatactctttaatagttctcgaaaatatcattttaccctccatttttgataataatttaacaggacataaaactaaaaattgacatttcttttctgttagcaatttttagatgtattttaattatcttcacaacatcctgttgttaattagaattatttacttgaattgccattcatttttagataatcctatgattgctgttaaaagtatctatctttgcattttatattttaaattcaatgtgtctaaatttggatttattcctatttatccctctcagaaagctgtgcattatttgagtacttgccttaaattctggaaaattactaagaattaagcatcaatatgcacagttctcattttcactactttcttcttctgtaattcttattattccaacatacacatgggatcttttcattctctcattttatgtgctatgttgcttaacttctcatatgtttttccctttttgttggtgctgcatcctttataatttcttcagatttatctttcaaagtactgattctttcttcagcttcatctgatcttctgtttaaattaactgagttttattttcaatgactgtatttttatttctattagttctatataattatttccaagcatgccttcttttgtctacttttaattcaatacacttcttaaacatatttattttattatatctttcaaattgttctattatttcagtaattgtcagggtgccatttctcctatttgctacatcaacagacactctatggtaatttgtttcttcttgggctttgaattgctgctgcaattgaacttatctttgaatattaaaaacactctgtgaaacaaattaccatttaatatttttgctttcataaaatagaatagtaaacaccagtgaaaaatagatgaactaaagctacatgcatcaatgtaaggagtcatataaaataatgtttataaaattcttggttaagaaatacatatagcatgatataaattttagaagtttaaaatatataatcaatgctacatattattttggattacatattcctatggtgaaaatttaaatatgtacaaaagaatgataaatatccaaatcagtagttacttatgagagaaagaagcagaaggagatccagcatgaatacaaatgagaatacaaattttgtaattgcttgtaatcttcagagtatattaacattcaatatagtgttctccacacatttctgtagattaatacataaaggcagtaaagtcattgagtagcctctcttccaaatataaaacaataaaaagataatcattaaagcaagtcttgtattaatattttaaactttaaatagattactaaaataaaactagaatatctgaaataggcccatctcttagaatttagtataataaaaccagagactgccacagaaaactaggcaaataatctaataattcacagaactataaatggccttgtatccatcaatctctctgtgaaatattttctacttatataaagtatgtatatttattattacctacatatatatacgtctatatctaaagatatataaagttagaaaaaaggaaaccaaactattattgaaatagtttaatagaggtagggttttaggtgatttaaaatttccagtgttctaaaataacaatattttaaaattatgttctgcttttatccaaattatatgctcatgcttaaaaagttatataattcagtggttgtacacaaaagccacagactactcttattacatactttttcctgcttctcagaggcaaccactttcaaatagtttgcatgattctatttttatttatatgcaaatttctctgcaatatgattatattgctacttcttaatttatttggatggggaagggatgatttagacactgtatattgacattctattttggaagatacaaatcaagcctttttcaacaccactttggcagaccttgctctctgacacacgtgtgtcctcagcctctcatcattatgtcatatcatggtttggttgcatatgcaatttttacattgccatattgatataagcactatttacaggatacacatgtcagacattacttctactcttccttttataaaaatattaatcctttttattttttcagtttattgtacgatttttaaattgtgtggttttgttgccattgctttctgtgttttagtaataatcgctaactgtcatttaatcctttgcccccatatcccatatatcacttttgttaatacatgtaaatatacaagaaattataaatttaccttgttaaatcaagccctcctgataaatctcatcctgctgcaaattaccctgggtgtttctccagacctgcctacagctgtcaccttgtgatgggtgattccctctacctttcttctagattggatgccctattccctagatttcttgtcctctttcttggtttaccagctaaaacatcttccagtaacattaagaaaataactgcacgggagataaaagtcttaaatactttgttgcatacttagccatagaaccctagattataactcatactgtctcatcagaatcacgaacacttggtcttattgtttactagcttatttcatattaatgttccctccaaaagcttaaatatttcctttctttgtatccagggtactgacttttcaatgatgtgtcttaagatggatctattgctattcataggactgggaacatggtcacatggtgagtctattcattataaaagcatatgtctttccattctgggaactttttatgatttttttttttcatgaattcctatgctatattttctgttttctccttccgggatttctatgttttaagacgttggattttctctgtgggttccctaattttattttattttatttctattcttattttttcctaatttcaatcttagacattttgcttttcattctggaacagcttttcaactttaccccctaaaactttcattgtatttttccatttacactatcttagtttccaacattaaaaaaaaaaaaatctgtgttcttgttttcgagatgaagaaccttttctcacatctttgaggatattaatcccagatattttgaagctttcttttggtgaaaacttttctccgagttattgtttgtttgttttagtctctttggtataacatgctttcttcaaatatctaataatccttgggattctgctataaaagcagagcacctctcctcctccaaaggaacgcagctcctcaccagcaacggaacaaagctggatggagaatgactttgacaagctgagagaagaaggcttcagacgatcaaattactctgagctaagggaggacattcaaaccaaagacaaagaagttgaaaactttgaaaaaaatgtagaagaatgtgtaactagaataaccaatacagagaagtgcttaaaggagctgatggagctgaaaaccaaggctcgagaactacgtgaagaatgcagaagcctcaggagccgatgtgatcaattggaagaaagggtatcagcaatggaagatgaaatgaatgaaatgaagtgagaagggaagtttagagaaaaaagaataaaaagaaacgagcaaagtctccaagaaatatgggactatgtgaaaagaccaaatctacgtctgattggtgtacctggaagtgatggggagaatggaaccaagttggaaaacactctgcaggatattatccaggagaacttcctcaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagactgggggccgatattcaacattcttgaagaaaagaattttcgacccagaatttcatatccagccaaactaagcttcataagtgaaggagaaataaaatactttacagacaagcaaatgctgagagattttgtcaccaccaggcctgccctaaaagagctgctgaaggaagcgctaaacttagaaaggaacaactggtaccagccgctgcaaaagcatgccaaaatgtaaagaacatcgagactaggaagaaactgcatcaactaacgagcaaaatcaccagctaacatcataatgacaggatcaaattcacacataaccatattaactttaaacgtaaatggactaaatgctccaattaaaagacacagactggcaaattggatcaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaactgactttaaaccaacaaagatcaaaagagacaaagaaggccattacataatggtagagggatcaattcaacaagaagagctaactatcctaaatatatatgcacccaatacaggagcacccagactcataaagcaagtcctgagtgacctacaaagagacttagactcccacacattaataatgggagactctaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaacaatctctcagaccacagtgcaaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcccacaagagaaagcaggaaggatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaatagagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagcagttgaatctctgaatagaccaataacaggatctgaaattgtggcaataatcaatagcttaccaaccaataagagtccaggaccagatggattcacagccgacttctaccagaggtacaaggaggaactggtaccattccttctgaaactattccaatcaatagaaaaagagggaatcctccctaactcattttatgaggccagcatcattctgataccaaagccgggccgagacacaaccaaaaaagcgaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatataagcaaatcaataaatgtaatccagcatataaacagaaccaaagacaaaaaccacgattatctcaatagatgcagaaaaggcctttgacaaaattcaacagcccttcatgctaaaaactctcaataaattaggtattgatgggacatatttcaaaataatatgagctatctatgacaaaccgacagccaatatcatactgaatgggcaaaaactggaagcattccctctgaaaatgggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaattcacaagcattcttatacaccaacaacagacaaacagagagccaaatcattagtgaactcccactcacaattgcttcaaagagaataaaatacctaggaatccaacttacaagggatgtgaaggacctcttcaaagagaacgacaaaccactgctcaacgacataaaagaggatacaaacaaatggaagaatattccatgctcatgggtaggaagaatcaatatcgtgaaaatggccatactgcctaaggtcatttacagattcaatgccatccccatcaagctaccaatgactttcttcacagaattggaaaaaactactttaaagttcatatggaaccaaaaaagagcccgcatctccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgaaaaacctgagaaaaacaagcaatggggaaaggattgcctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaagacaaaattgacaaatgggatctaattaaactgaagagcttctgcacagcaaaagaaattaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaaagaagacatttatgcagccaacagacacatgaaaaaatgctcatcatcactggccatcagagaaatgcaaatcaaaaccacaatgagataccatctcacaccagttagaatggcgatcattaaaaagtcagaaaacgacaggtgctggagaggatgtggagaaataggaacacttttacactgttggtgcgactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaaaatgatagactggattaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccacgtattctcactcatatgtgggaattgaacaatgagatcacatggacacaggaaggggaacatcacactctggggactgtggtggggtggggggaggggggagggatagcattgggagatatacctaatgctagatgacgagttagtgggtgcagcacaccagcatggcacatgtatatgtatgtaactaagctgcacaatgtgcacatgtaccctaaaacttaaagtataataaaaataaaaatagaataaaaccaaaaaaaaaaaacaatgggtctgttgaacccatttttcactatgatctagctgatttcgttctacttaagggttttctgctgccatttttgttaggtcttttctcttgagtaagacatattccctacagaagattcatacattttcctgctcggatgaaacttggctgcctgggttctgctgtagatctcaataagaggggagagtcaggcagggtgaagtgtttcagcgtttagtatgcatattcctcctttcagttttgtattcctatcctgtgtccacgtgtcctccaggccagagaacctgttttatcctctttggggaataaagttcttcttttctagtagggggagtgaagagtagtagccttattttgaagaacaggaaaagcaacacagaagtctaactgttcaagagactccaaactacttttatggtatttagccataatttcatctcttttggcaaaagtccctggtgggacaaatcttaaattttacaaaagagtatcgtaatgaacactggggggctttttaactttctgcactgtcattttagcagaaagaaagaaagaaaaaagctgaatcttacttacctagtttccagcttcaaaaatgtttcatttgtgatctttcaattttgcttttgagctcgtgtgtgtgtttaattactcttactggtctattgcatccttagaagtggtattcccaaaaaaagaatctatataaataaaaacctatttgatgatgatttgaataggaaaccatgccccaaataaagagatttagagaaaaaagtagtatatttgccaaatctcttaagtaaccatgctttggtttcttatttattgaaagaaaagttcaggtccactattaaatataagaattgataataatgactaggatgtttacttcttcaggatgcatatacattcaatttgcaatcaaataaattctaaaaactgtcatcaagtaaatattcagacactgtcagcactttattggaagagttgtgagtatttgatcttgcagattactaatactctccagagagggacttttcatgttttcagttttcaatttacaactgtgggtcaaagtcaacaccttttgtgtcttcatctgaaaatgtctcagatctttattctgaaatgtcttcaaattgctgcttgagaatatatgtcccatttcacccaggagaatgtttccctctgttagaaacaatgcattttgttttgtctctctccagtggcctcatgtatagaatttcaaacataataggtcattgcacatgcattttattgcctgtaagtcttacagcttgtagtatgctcttccaacctcaggttccaagatcctacagtacatggccactgacggcctttggtatatgactgtgtaataatggaatctattttcttgaccaaacactgtgtaatagcttttattattttctttcaacccatgtaacttacataagaaatacaatcaaaattctctttttttcacaagttacaaagtttttatgtcagtcttgtgtccttttctccatttttctgttaaattttttttgttctgtacaagattgtccttttatgtttgccagtatttaagttgtttgggggaaatatttatatctccaggatgtttttcatttcaagaaaagtttagtgtacctcaactggatctgaggctggaatctaggaaaaacagagaataatccagggacttactttcaccagcttaaaaatactataaaatcatcctctctattctccaacatctgtacatagagtagaggaacagcaaggagcactgggaaaagcctgtgtagccacatgcagcctcctactcaaagctgcctttggtcttcttctctgtatctcccaagttaagcagcttatatttaggaggaaaaaaaaaaaaaaaagaaaaatgaaagatgatctgctcaccactgattacgttaccaatacttctcatcttttgggtactgtgaggattaatagtatgtatctgtatagctggcccacattgcccagataatctggctaagcattattctggatgtttctgaaagggtgattttgggtaagattacatttaaatcagcagatttgggtaaagtaagttgctccccataatgtgggtgtgcctcatctaatcagttgaaggattaggaaaaatctggtcttgatctttctgaacaagagaaattcttcaggctatcagccttcagacttgaactttagcattagctctttcttgggtctccagcctgccaacccactttgcacattttaaacatgtcagcctctataactgaataaggcaatccttaagtcatcttctatatacgtatacacatcctattgattgtcttttttctaaagaattatgactaatataaagactagcaggcattatttgggtgtgattatatatatatttgagtctttatgccacactgtttggcgtttttattttttacaattttatttatttatatatttttttgagacagggtctcactctgtcacccaggttggagtgcattggtgcaatcttggctcactgcatcttccacctccccagctcaagcgatcctctcacctcaacctcccaagtagctggaaccacaggtgcacaccaccatgcttggctaatttgtgtgtgtgtgtgtttttggtagagatggggtttctccaagttgctcaggctggtctcgaactcctgagctcaagtgatccacctgctatggcttcccaaagtgccgggattacaggtataagccaccacacctggcctcattcttcttcttaaacatataagttttgtgtaaaatacacaacgaagaggacacagtattgtgtttttccaaacaaaattgccagctcttctgttgaaattaaagtggcaagtgaggaaagaaggagggaggagtacatgatacgatacttatcagtacccttatgtttttgtaactcctaccactaattttctcttaccatatgcactctgccacactccttatttcccaggctccctttagaatgcccaaccaccctatagaaaatgagtacgaactctgaagacatcattggatagagttaccgttaaaaaaaattcactcaatgttattcagagtcattttcaaagaaacagctctggccactaggagatacgaacctgagtatcatagggaatctgtggattaaaacagattacttatagtagtaagcaaaataaagtgtaggagaacctctgatagttactttttaaatttacctcaggagatttgtccctgtttctataattagtttataaagaaccttatatttattttaaatattttatatctatgctacttatacatcagtaattggtttaatagatttatatataatataatgtgtttatatattatatataaatgtattatatatgtataatatatataaattatatataaatgtattatatatgtataatatatataaattatatataaatgtattatatatgtataatatatataaattatatataaatgtattatatataattttgtgtgtgtgtgtgtatatatatatatatatatatatatatatataaaaaatatgctactagaactgaaaaagacagtagagaaggctgaaggatttaagcttcacactcctacagacatacctttacacagtgaggatgaagcactgcacacagatctgtggtgtaccaatatgcacttaatgagcactccagctctctgcttttcaatttgtactcgctgaacttctattttttaaactgaaaacaaacaaaaacactgtcatccttttttcttgatgtatctgcaatagccactttgaactcctctggtaccttatcaaataaccccatacagtgggcagtctgcagagattgcagggaactacaagaagggtccacataatatggtgtgttacagttactaaaaatgctctgctaatgaaccaagctaagatgattggtctcctcgttcatagaacttttcagtttttcaggaaatagaaggtctacttttttctgaagaattacaagtaaggaacgatgattattagagattagaaagcattgttctttttttcctctattggtgaattattctcagtgagctaaggctttcctgaccgccagtttcacaactctcccacataaccatctctaatctctcatgtataaagtcaaaatgaatgttttccaagaattcaatattcttcaacaggaaataagcaatgtgcatttactttcaaaaaaaaaaaaaaaaaacagaaaaaacaaaaaattggtccccattaagcaaatttcaccaggaaagtatatgtttccttcacagagttataggaaaataaatttctacaaagctttcctgtgtcatgctaaaagggttagtgatgaggatataaggtttacaatgttaaagctgcaaaggaatgtgtctttatgatgaggtgagcctctttctgatgttgtaaaggtggttgaaatacctcactctcccatttttctgacagattttatattttaaaagctttggacaggatagacacaaatagcttttactgcattttacatatagttaccacatttaatcattacaaaaactgtttgaataaaacttatttatttatttgtgtatttatttatttatttattttgggatggagtctctctctgtcacccaggctgcagtgcagtggcacaatctcggctcactgcaaactccatctcccgggttcaagcgattatcctgcctcagcctcccaagtagtggggacaacaggcgcatgcgaccacgccctgctaatttttgtatttttagtagagatggggtttcaccatgttggccgggctggtctcaaattcctgacctcaagtgatccacccaccttggcctcccaaagtgctggaattataggcctgaaccacatgcctggcctgaataaaacttgttattttcattttatagatgagggaactaactttcagtgaggttaaatattttgatcaaaacctcagaactaataaagggaagagccaggaattaaatccagatctatcactgtctacttttttatactatctcctctctgggaatatcaataaattaaaatcgggtacttacagaattctcaattgtaacgacaaatctagaatatcagggtttctgtacttagtgaccagaagtcatacagctttctatttacgtctaagttcaaaacatattctggacaataaaagaataatcctctctaaagacaaattttggcaaggaaaaatgcagtccaatttgcttgcattataaaaatagaaacacatgtaatctcaaattaactgtctttgttttctgcagttctatgcaaatgcaaatatgcaaaagaacaaatgcttgatagaaaaaaatgtacatgttggcagttcattatccttgtgtttttcttaattgatgagtgctttctctgttgaaactcttaagatcgctcagattccctggcataagtcctcatgaaaaatcatctaaatgatatctttgtggagactatgatgctcaatcagacattttggctaacatactaggctgctgatctgacattcagtgcccagaatcgcggctgctgagccaagtaaaccacctcctgagttgtttctggtccaatctgtggtatctctgccaacgggttttctagatagttagacccctcctacctatgcataacaatgagctagcatgctagcaaagtcccaatttttataaatgtagtgatgcatcctacagatacataaagtcactgataatcagaccaatgtctgcacatacgtgtttaaatcaattacaatgacaaatagatgctttatgagaccatgactattcagaaccttattttagacacttaacacattggtaaccatcacagaaacaatgaaaaagaattgtggggaaaagtaaaataacaaaataattatcttttgctgatttaatatcatatggaacaatagtcttttacatagaaagaaaatatgattatattattgaagcatcctgcactttcaaaatgtaatcaatcattataggtagtctcctaagattagagtcatacataagaaatcataaggaaatctagatctgcaaaagtagatgaaccgggagtagataattctaaataaaccaattgtgcttttttaaaataaataatccagtttacttgagtcacttcaccagacttacaggcaccaaccctacctctatcttagattacagttacaactaaccaagttcttgtctcctcaacctcctccaatttgcctttcatacagcaagcagaggaatctactaagagcactgttgtagttgcgttactaccctgccttaaagcatttatgctcctcctcctttcaccactgctgtcacacatgctgtatgcccaaattctttatcttgaatcttagggctccaatgtgcttttcaagaattttcttttctctgtttataacattagacctatgcttgcaccaataaacctgcactgtttaatgcaattgttaccggcgatgtgtgtcactttacacttaaatcagataaaattaaaaattcagttcctctactgcactagccacatttcgagtcttcaatagtcacttgtgactagtggctacggtattggacagtgccgattatacatcattgcagagttctatggcacagcactgctgcatacctgccctgaggttctatggtatgaagctgtctgcaagttctgatacatgttattcccttaaagtagaaatgctcttgcttcctgtacacccctccaaatttacaaactgaaattccatcacccttcaaagtgtaggctacttttcatattttctattccctccacccgtatatattccatttagaaatgatctccaacacttctgaaatttttttgagtttaatttataatattcacatgtaaaatctcatactgctgctttaaactatcaaaaaataggaatatatataagtctcactctgtcgcccaggctggagtgcagtggcgccatctcagctcattacaagctccgcctcctgggttcatgccattctcctgcctcagcctcccaagtagctgggactacaggcgcctgccaccacgcccgggtaattttttgtactttttagtagagacggggtttcaccatgttagccaggatgatctcgatctgacctcgtgatacccctgcctcagcctcccaaagtgctgggattgtaggcgtgaggcatcatgcctgataaggaaaaattatttttatttttttttttttacagacatctagagacagagagaaggagagatctaggcaaaagaattatttttttgagacggagtctcgctctgtcgcccaggctggagtgcagtgtcgcgatctctgctcactgcaagctctgccttccgggttcatgccattctcctgcctcagcctcctgagtagctgggactacaggcgcccaccaccacgcccacctaattttttttgtattttttagtagagacggggtttcaccatgttagccaggatggtctcgatctcctgacctcgtgatccacccgcctcggcctcccaaagtgctgggattacaggcgtgagccactgtgacgagcccaaaaggattattttcttgctaacttggggaaaggtgaaaggctatatagctttgtcttctcagacactcttggggctttacactcaatagctgtatatctatatatctatatctgtatattaaaaatatgaacatataatccaccattttgtgaaactttttttcatttaccaggagaaaactgaggaccagcgaagtggcctgcagaagtaacaaactccttaacaagtgctatggcaccagctcatcagaatggacactggctttaatggtattaactgagtcctaaaggccctcttctccttatttcctgaatattgggaagatccaaaggtttctgcaacaaaggggacaaccaagtaaatggtggaggaggatcttttaggggctcgtggctgaagccactttgtctaccagaatggcaccatttcaatattttgtcaatgaatatagctacacctatgcttattaaacaagtctggtgacataattgtcccaagttcatacagtcagtagaatttgccatcaaacaactttaaaacaacttttcaggaatataactactatgccacatgaaatacccaccttctgggatattgaagcaaaagcttttcaactgctaaataggcacatgatctttataccattggtataatgtcacgtacatttgtgtgcagattaccacatccctgaaaactgctccctcagatgttgtgtatggggtaattgatgctttaggcctaaaaatctaaataagctgacacttttattttcagaagtgcctgcaaggggtgcaattcaaaaaaattacatttcaacctggctgattggctaataaaatgaaagtagtttgtaacaaataaacaagtaaaggatatggcatgctttgcactgcttttaacataaatgagtaaaatcacatcatttctttcaataaaaacatcttgtgcctaaaataaaatgcctgatgttgatactgaaatggtatgctttcatctaaaatatttttgatagctcgttgttgccaacacttaaaacaaaaagttgctaacttctttaaagtggccaactacagtagtgcaaaaccaatagttgatatgatattatttttagccttcatcttcagctttaagtaatgttcagtaaatgcaacattacttccttattgatatttatccatgactccacacagaaaacaataaacaaataaaccttattcataaggctgtctatataccagtggtcattttatagtcagaatttttttgcatttaaaaaggcagctattatgttggtgaggatgcagagaaaagggaatgcttatacactgctggtggcaatgcaaattagttcaacttctgtggaaaacagtagaaaatttctcaaagaattaaaaatagaactaactaccatttgacccagcaataccaccattggctatttacccaaaggaaaagaaattgttttatcaaaaagacacctagcactcaatatgtttatcatagcactagtcacattagcaaaggcacagaatcaacctaagggtccatcaacagtgggctggattaaacaaaaagtggtacatatacactgtgaaataatatgcagccatagaaaaaaacaaaatcatgccttttgcagtaacatggatggagctacagatcattatcctaagtgaaataactcagaaacaggcaatcaaatattacatgctcttacttataagtggaagttaagcaatgtgtacacatggacataaagatgtaaataatagacactggggactccaaaagtgaagaggatgggagagaggcaagggttgaaaaactaccttttcggtactatgttcctatttgggtgacgggttcattagaagcacaaacctcagcattatacaatatacttatggaacgaacctgcacatgtacttcctgaatctaaaataaataaataaataaataaataaataaatttataaggagctgttaaatacttctagattcaaagcatggaaggcttttctttcctcttccctcctcatgcagttcttactctgactctactcactgctattttacagtcagttcgaacaagcaaagctgacttcccatcccacaaaataaaagattcagcaaatcaccaggga

SEQ ID NO: 464 - DNA, 34196 bp, Homo sapiens
acttgccttaaattctggaaaattactaagaattaagcatcaatatgcacagttctcattttcactactttcttcttctgtaattcttattattccaacatacacatgggatcttttcattctctcattttatgtgctatgttgcttaacttctcatatgtttttccctttttgttggtgctgcatcctttataatttcttcagatttatctttcaaagtactgattctttcttcagcttcatctgatcttctgtttaaattaactgagttttattttcaatgactgtatttttatttctattagttctatataattatttccaagcatgccttcttttgtctacttttaattcaatacacttcttaaacatatttattttattatatctttcaaattgttctattatttcagtaattgtcagggtgccatttctcctatttgctacatcaacagacactctatggtaatttgtttcttcttgggctttgaattgctgctgcaattgaacttatctttgaatattaaaaacactctgtgaaacaaattaccatttaatatttttgctttcataaaatagaatagtaaacaccagtgaaaaatagatgaactaaagctacatgcatcaatgtaaggagtcatataaaataatgtttataaaattcttggttaagaaatacatatagcatgatataaattttagaagtttaaaatatataatcaatgctacatattattttggattacatattcctatggtgaaaatttaaatatgtacaaaagaatgataaatatccaaatcagtagttacttatgagagaaagaagcagaaggagatccagcatgaatacaaatgagaatacaaattttgtaattgcttgtaatcttcagagtatattaacattcaatatagtgttctccacacatttctgtagattaatacataaaggcagtaaagtcattgagtagcctctcttccaaatataaaacaataaaaagataatcattaaagcaagtcttgtattaatattttaaactttaaatagattactaaaataaaactagaatatctgaaataggcccatctcttagaatttagtataataaaaccagagactgccacagaaaactaggcaaataatctaataattcacagaactataaatggccttgtatccatcaatctctctgtgaaatattttctacttatataaagtatgtatatttattattacctacatatatatacgtctatatctaaagatatataaagttagaaaaaaggaaaccaaactattattgaaatagtttaatagaggtagggttttaggtgatttaaaatttccagtgttctaaaataacaatattttaaaattatgttctgcttttatccaaattatatgctcatgcttaaaaagttatataattcagtggttgtacacaaaagccacagactactcttattacatactttttcctgcttctcagaggcaaccactttcaaatagtttgcatgattctatttttatttatatgcaaatttctctgcaatatgattatattgctacttcttaatttatttggatggggaagggatgatttagacactgtatattgacattctattttggaagatacaaatcaagcctttttcaacaccactttggcagaccttgctctctgacacacgtgtgtcctcagcctctcatcattatgtcatatcatggtttggttgcatatgcaatttttacattgccatattgatataagcactatttacaggatacacatgtcagacattacttctactcttccttttataaaaatattaatcctttttattttttcagtttattgtacgatttttaaattgtgtggttttgttgccattgctttctgtgttttagtaataatcgctaactgtcatttaatcctttgcccccatatcccatatatcacttttgttaatacatgtaaatatacaagaaattataaatttaccttgttaaatcaagccctcctgataaatctcatcctgctgcaaattaccctgggtgtttctccagacctgcctacagctgtcaccttgtgatgggtgattccctctacctttcttctagattggatgccctattccctagatttcttgtcctctttcttggtttaccagctaaaacatcttccagtaacattaagaaaataactgcacgggagataaaagtcttaaatactttgttgcatacttagccatagaaccctagattataactcatactgtctcatcagaatcacgaacacttggtcttattgtttactagcttatttcatattaatgttccctccaaaagcttaaatatttcctttctttgtatccagggtactgacttttcaatgatgtgtcttaagatggatctattgctattcataggactgggaacatggtcacatggtgagtctattcattataaaagcatatgtctttccattctgggaactttttatgatttttttttttcatgaattcctatgctatattttctgttttctccttccgggatttctatgttttaagacgttggattttctctgtgggttccctaattttattttattttatttctattcttattttttcctaatttcaatcttagacattttgcttttcattctggaacagcttttcaactttaccccctaaaactttcattgtatttttccatttacactatcttagtttccaacattaaaaaaaaaaaaatctgtgttcttgttttcgagatgaagaaccttttctcacatctttgaggatattaatcccagatattttgaagctttcttttggtgaaaacttttctccgagttattgtttgtttgttttagtctctttggtataacatgctttcttcaaatatctaataatccttgggattctgctataaaagcagagcacctctcctcctccaaaggaacgcagctcctcaccagcaacggaacaaagctggatggagaatgactttgacaagctgagagaagaaggcttcagacgatcaaattactctgagctaagggaggacattcaaaccaaagacaaagaagttgaaaactttgaaaaaaatgtagaagaatgtgtaactagaataaccaatacagagaagtgcttaaaggagctgatggagctgaaaaccaaggctcgagaactacgtgaagaatgcagaagcctcaggagccgatgtgatcaattggaagaaagggtatcagcaatggaagatgaaatgaatgaaatgaagtgagaagggaagtttagagaaaaaagaataaaaagaaacgagcaaagtctccaagaaatatgggactatgtgaaaagaccaaatctacgtctgattggtgtacctggaagtgatggggagaatggaaccaagttggaaaacactctgcaggatattatccaggagaacttcctcaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagactgggggccgatattcaacattcttgaagaaaagaattttcgacccagaatttcatatccagccaaactaagcttcataagtgaaggagaaataaaatactttacagacaagcaaatgctgagagattttgtcaccaccaggcctgccctaaaagagctgctgaaggaagcgctaaacttagaaaggaacaactggtaccagccgctgcaaaagcatgccaaaatgtaaagaacatcgagactaggaagaaactgcatcaactaacgagcaaaatcaccagctaacatcataatgacaggatcaaattcacacataaccatattaactttaaacgtaaatggactaaatgctccaattaaaagacacagactggcaaattggatcaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaactgactttaaaccaacaaagatcaaaagagacaaagaaggccattacataatggtagagggatcaattcaacaagaagagctaactatcctaaatatatatgcacccaatacaggagcacccagactcataaagcaagtcctgagtgacctacaaagagacttagactcccacacattaataatgggagactctaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaacaatctctcagaccacagtgcaaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcccacaagagaaagcaggaaggatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaatagagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagcagttgaatctctgaatagaccaataacaggatctgaaattgtggcaataatcaatagcttaccaaccaataagagtccaggaccagatggattcacagccgacttctaccagaggtacaaggaggaactggtaccattccttctgaaactattccaatcaatagaaaaagagggaatcctccctaactcattttatgaggccagcatcattctgataccaaagccgggccgagacacaaccaaaaaagcgaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatataagcaaatcaataaatgtaatccagcatataaacagaaccaaagacaaaaaccacgattatctcaatagatgcagaaaaggcctttgacaaaattcaacagcccttcatgctaaaaactctcaataaattaggtattgatgggacatatttcaaaataatatgagctatctatgacaaaccgacagccaatatcatactgaatgggcaaaaactggaagcattccctctgaaaatgggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaattcacaagcattcttatacaccaacaacagacaaacagagagccaaatcattagtgaactcccactcacaattgcttcaaagagaataaaatacctaggaatccaacttacaagggatgtgaaggacctcttcaaagagaacgacaaaccactgctcaacgacataaaagaggatacaaacaaatggaagaatattccatgctcatgggtaggaagaatcaatatcgtgaaaatggccatactgcctaaggtcatttacagattcaatgccatccccatcaagctaccaatgactttcttcacagaattggaaaaaactactttaaagttcatatggaaccaaaaaagagcccgcatctccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgaaaaacctgagaaaaacaagcaatggggaaaggattgcctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaagacaaaattgacaaatgggatctaattaaactgaagagcttctgcacagcaaaagaaattaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaaagaagacatttatgcagccaacagacacatgaaaaaatgctcatcatcactggccatcagagaaatgcaaatcaaaaccacaatgagataccatctcacaccagttagaatggcgatcattaaaaagtcagaaaacgacaggtgctggagaggatgtggagaaataggaacacttttacactgttggtgcgactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaaaatgatagactggattaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccacgtattctcactcatatgtgggaattgaacaatgagatcacatggacacaggaaggggaacatcacactctggggactgtggtggggtggggggaggggggagggatagcattgggagatatacctaatgctagatgacgagttagtgggtgcagcacaccagcatggcacatgtatatgtatgtaactaagctgcacaatgtgcacatgtaccctaaaacttaaagtataataaaaataaaaatagaataaaaccaaaaaaaaaaaacaatgggtctgttgaacccatttttcactatgatctagctgatttcgttctacttaagggttttctgctgccatttttgttaggtcttttctcttgagtaagacatattccctacagaagattcatacattttcctgctcggatgaaacttggctgcctgggttctgctgtagatctcaataagaggggagagtcaggcagggtgaagtgtttcagcgtttagtatgcatattcctcctttcagttttgtattcctatcctgtgtccacgtgtcctccaggccagagaacctgttttatcctctttggggaataaagttcttcttttctagtagggggagtgaagagtagtagccttattttgaagaacaggaaaagcaacacagaagtctaactgttcaagagactccaaactacttttatggtatttagccataatttcatctcttttggcaaaagtccctggtgggacaaatcttaaattttacaaaagagtatcgtaatgaacactggggggctttttaactttctgcactgtcattttagcagaaagaaagaaagaaaaaagctgaatcttacttacctagtttccagcttcaaaaatgtttcatttgtgatctttcaattttgcttttgagctcgtgtgtgtgtttaattactcttactggtctattgcatccttagaagtggtattcccaaaaaaagaatctatataaataaaaacctatttgatgatgatttgaataggaaaccatgccccaaataaagagatttagagaaaaaagtagtatatttgccaaatctcttaagtaaccatgctttggtttcttatttattgaaagaaaagttcaggtccactattaaatataagaattgataataatgactaggatgtttacttcttcaggatgcatatacattcaatttgcaatcaaataaattctaaaaactgtcatcaagtaaatattcagacactgtcagcactttattggaagagttgtgagtatttgatcttgcagattactaatactctccagagagggacttttcatgttttcagttttcaatttacaactgtgggtcaaagtcaacaccttttgtgtcttcatctgaaaatgtctcagatctttattctgaaatgtcttcaaattgctgcttgagaatatatgtcccatttcacccaggagaatgtttccctctgttagaaacaatgcattttgttttgtctctctccagtggcctcatgtatagaatttcaaacataataggtcattgcacatgcattttattgcctgtaagtcttacagcttgtagtatgctcttccaacctcaggttccaagatcctacagtacatggccactgacggcctttggtatatgactgtgtaataatggaatctattttcttgaccaaacactgtgtaatagcttttattattttctttcaacccatgtaacttacataagaaatacaatcaaaattctctttttttcacaagttacaaagtttttatgtcagtcttgtgtccttttctccatttttctgttaaattttttttgttctgtacaagattgtccttttatgtttgccagtatttaagttgtttgggggaaatatttatatctccaggatgtttttcatttcaagaaaagtttagtgtacctcaactggatctgaggctggaatctaggaaaaacagagaataatccagggacttactttcaccagcttaaaaatactataaaatcatcctctctattctccaacatctgtacatagagtagaggaacagcaaggagcactgggaaaagcctgtgtagccacatgcagcctcctactcaaagctgcctttggtcttcttctctgtatctcccaagttaagcagcttatatttaggaggaaaaaaaaaaaaaaaagaaaaatgaaagatgatctgctcaccactgattacgttaccaatacttctcatcttttgggtactgtgaggattaatagtatgtatctgtatagctggcccacattgcccagataatctggctaagcattattctggatgtttctgaaagggtgattttgggtaagattacatttaaatcagcagatttgggtaaagtaagttgctccccataatgtgggtgtgcctcatctaatcagttgaaggattaggaaaaatctggtcttgatctttctgaacaagagaaattcttcaggctatcagccttcagacttgaactttagcattagctctttcttgggtctccagcctgccaacccactttgcacattttaaacatgtcagcctctataactgaataaggcaatccttaagtcatcttctatatacgtatacacatcctattgattgtcttttttctaaagaattatgactaatataaagactagcaggcattatttgggtgtgattatatatatatttgagtctttatgccacactgtttggcgtttttattttttacaattttatttatttatatatttttttgagacagggtctcactctgtcacccaggttggagtgcattggtgcaatcttggctcactgcatcttccacctccccagctcaagcgatcctctcacctcaacctcccaagtagctggaaccacaggtgcacaccaccatgcttggctaatttgtgtgtgtgtgtgtttttggtagagatggggtttctccaagttgctcaggctggtctcgaactcctgagctcaagtgatccacctgctatggcttcccaaagtgccgggattacaggtataagccaccacacctggcctcattcttcttcttaaacatataagttttgtgtaaaatacacaacgaagaggacacagtattgtgtttttccaaacaaaattgccagctcttctgttgaaattaaagtggcaagtgaggaaagaaggagggaggagtacatgatacgatacttatcagtacccttatgtttttgtaactcctaccactaattttctcttaccatatgcactctgccacactccttatttcccaggctccctttagaatgcccaaccaccctatagaaaatgagtacgaactctgaagacatcattggatagagttaccgttaaaaaaaattcactcaatgttattcagagtcattttcaaagaaacagctctggccactaggagatacgaacctgagtatcatagggaatctgtggattaaaacagattacttatagtagtaagcaaaataaagtgtaggagaacctctgatagttactttttaaatttacctcaggagatttgtccctgtttctataattagtttataaagaaccttatatttattttaaatattttatatctatgctacttatacatcagtaattggtttaatagatttatatataatataatgtgtttatatattatatataaatgtattatatatgtataatatatataaattatatataaatgtattatatatgtataatatatataaattatatataaatgtattatatatgtataatatatataaattatatataaatgtattatatataattttgtgtgtgtgtgtgtatatatatatatatatatatatatatatataaaaaatatgctactagaactgaaaaagacagtagagaaggctgaaggatttaagcttcacactcctacagacatacctttacacagtgaggatgaagcactgcacacagatctgtggtgtaccaatatgcacttaatgagcactccagctctctgcttttcaatttgtactcgctgaacttctattttttaaactgaaaacaaacaaaaacactgtcatccttttttcttgatgtatctgcaatagccactttgaactcctctggtaccttatcaaataaccccatacagtgggcagtctgcagagattgcagggaactacaagaagggtccacataatatggtgtgttacagttactaaaaatgctctgctaatgaaccaagctaagatgattggtctcctcgttcatagaacttttcagtttttcaggaaatagaaggtctacttttttctgaagaattacaagtaaggaacgatgattattagagattagaaagcattgttctttttttcctctattggtgaattattctcagtgagctaaggctttcctgaccgccagtttcacaactctcccacataaccatctctaatctctcatgtataaagtcaaaatgaatgttttccaagaattcaatattcttcaacaggaaataagcaatgtgcatttactttcaaaaaaaaaaaaaaaaaacagaaaaaacaaaaaattggtccccattaagcaaatttcaccaggaaagtatatgtttccttcacagagttataggaaaataaatttctacaaagctttcctgtgtcatgctaaaagggttagtgatgaggatataaggtttacaatgttaaagctgcaaaggaatgtgtctttatgatgaggtgagcctctttctgatgttgtaaaggtggttgaaatacctcactctcccatttttctgacagattttatattttaaaagctttggacaggatagacacaaatagcttttactgcattttacatatagttaccacatttaatcattacaaaaactgtttgaataaaacttatttatttatttgtgtatttatttatttatttattttgggatggagtctctctctgtcacccaggctgcagtgcagtggcacaatctcggctcactgcaaactccatctcccgggttcaagcgattatcctgcctcagcctcccaagtagtggggacaacaggcgcatgcgaccacgccctgctaatttttgtatttttagtagagatggggtttcaccatgttggccgggctggtctcaaattcctgacctcaagtgatccacccaccttggcctcccaaagtgctggaattataggcctgaaccacatgcctggcctgaataaaacttgttattttcattttatagatgagggaactaactttcagtgaggttaaatattttgatcaaaacctcagaactaataaagggaagagccaggaattaaatccagatctatcactgtctacttttttatactatctcctctctgggaatatcaataaattaaaatcgggtacttacagaattctcaattgtaacgacaaatctagaatatcagggtttctgtacttagtgaccagaagtcatacagctttctatttacgtctaagttcaaaacatattctggacaataaaagaataatcctctctaaagacaaattttggcaaggaaaaatgcagtccaatttgcttgcattataaaaatagaaacacatgtaatctcaaattaactgtctttgttttctgcagttctatgcaaatgcaaatatgcaaaagaacaaatgcttgatagaaaaaaatgtacatgttggcagttcattatccttgtgtttttcttaattgatgagtgctttctctgttgaaactcttaagatcgctcagattccctggcataagtcctcatgaaaaatcatctaaatgatatctttgtggagactatgatgctcaatcagacattttggctaacatactaggctgctgatctgacattcagtgcccagaatcgcggctgctgagccaagtaaaccacctcctgagttgtttctggtccaatctgtggtatctctgccaacgggttttctagatagttagacccctcctacctatgcataacaatgagctagcatgctagcaaagtcccaatttttataaatgtagtgatgcatcctacagatacataaagtcactgataatcagaccaatgtctgcacatacgtgtttaaatcaattacaatgacaaatagatgctttatgagaccatgactattcagaaccttattttagacacttaacacattggtaaccatcacagaaacaatgaaaaagaattgtggggaaaagtaaaataacaaaataattatcttttgctgatttaatatcatatggaacaatagtcttttacatagaaagaaaatatgattatattattgaagcatcctgcactttcaaaatgtaatcaatcattataggtagtctcctaagattagagtcatacataagaaatcataaggaaatctagatctgcaaaagtagatgaaccgggagtagataattctaaataaaccaattgtgcttttttaaaataaataatccagtttacttgagtcacttcaccagacttacaggcaccaaccctacctctatcttagattacagttacaactaaccaagttcttgtctcctcaacctcctccaatttgcctttcatacagcaagcagaggaatctactaagagcactgttgtagttgcgttactaccctgccttaaagcatttatgctcctcctcctttcaccactgctgtcacacatgctgtatgcccaaattctttatcttgaatcttagggctccaatgtgcttttcaagaattttcttttctctgtttataacattagacctatgcttgcaccaataaacctgcactgtttaatgcaattgttaccggcgatgtgtgtcactttacacttaaatcagataaaattaaaaattcagttcctctactgcactagccacatttcgagtcttcaatagtcacttgtgactagtggctacggtattggacagtgccgattatacatcattgcagagttctatggcacagcactgctgcatacctgccctgaggttctatggtatgaagctgtctgcaagttctgatacatgttattcccttaaagtagaaatgctcttgcttcctgtacacccctccaaatttacaaactgaaattccatcacccttcaaagtgtaggctacttttcatattttctattccctccacccgtatatattccatttagaaatgatctccaacacttctgaaatttttttgagtttaatttataatattcacatgtaaaatctcatactgctgctttaaactatcaaaaaataggaatatatataagtctcactctgtcgcccaggctggagtgcagtggcgccatctcagctcattacaagctccgcctcctgggttcatgccattctcctgcctcagcctcccaagtagctgggactacaggcgcctgccaccacgcccgggtaattttttgtactttttagtagagacggggtttcaccatgttagccaggatgatctcgatctgacctcgtgatacccctgcctcagcctcccaaagtgctgggattgtaggcgtgaggcatcatgcctgataaggaaaaattatttttatttttttttttttacagacatctagagacagagagaaggagagatctaggcaaaagaattatttttttgagacggagtctcgctctgtcgcccaggctggagtgcagtgtcgcgatctctgctcactgcaagctctgccttccgggttcatgccattctcctgcctcagcctcctgagtagctgggactacaggcgcccaccaccacgcccacctaattttttttgtattttttagtagagacggggtttcaccatgttagccaggatggtctcgatctcctgacctcgtgatccacccgcctcggcctcccaaagtgctgggattacaggcgtgagccactgtgacgagcccaaaaggattattttcttgctaacttggggaaaggtgaaaggctatatagctttgtcttctcagacactcttggggctttacactcaatagctgtatatctatatatctatatctgtatattaaaaatatgaacatataatccaccattttgtgaaactttttttcatttaccaggagaaaactgaggaccagcgaagtggcctgcagaagtaacaaactccttaacaagtgctatggcaccagctcatcagaatggacactggctttaatggtattaactgagtcctaaaggccctcttctccttatttcctgaatattgggaagatccaaaggtttctgcaacaaaggggacaaccaagtaaatggtggaggaggatcttttaggggctcgtggctgaagccactttgtctaccagaatggcaccatttcaatattttgtcaatgaatatagctacacctatgcttattaaacaagtctggtgacataattgtcccaagttcatacagtcagtagaatttgccatcaaacaactttaaaacaacttttcaggaatataactactatgccacatgaaatacccaccttctgggatattgaagcaaaagcttttcaactgctaaataggcacatgatctttataccattggtataatgtcacgtacatttgtgtgcagattaccacatccctgaaaactgctccctcagatgttgtgtatggggtaattgatgctttaggcctaaaaatctaaataagctgacacttttattttcagaagtgcctgcaaggggtgcaattcaaaaaaattacatttcaacctggctgattggctaataaaatgaaagtagtttgtaacaaataaacaagtaaaggatatggcatgctttgcactgcttttaacataaatgagtaaaatcacatcatttctttcaataaaaacatcttgtgcctaaaataaaatgcctgatgttgatactgaaatggtatgctttcatctaaaatatttttgatagctcgttgttgccaacacttaaaacaaaaagttgctaacttctttaaagtggccaactacagtagtgcaaaaccaatagttgatatgatattatttttagccttcatcttcagctttaagtaatgttcagtaaatgcaacattacttccttattgatatttatccatgactccacacagaaaacaataaacaaataaaccttattcataaggctgtctatataccagtggtcattttatagtcagaatttttttgcatttaaaaaggcagctattatgttggtgaggatgcagagaaaagggaatgcttatacactgctggtggcaatgcaaattagttcaacttctgtggaaaacagtagaaaatttctcaaagaattaaaaatagaactaactaccatttgacccagcaataccaccattggctatttacccaaaggaaaagaaattgttttatcaaaaagacacctagcactcaatatgtttatcatagcactagtcacattagcaaaggcacagaatcaacctaagggtccatcaacagtgggctggattaaacaaaaagtggtacatatacactgtgaaataatatgcagccatagaaaaaaacaaaatcatgccttttgcagtaacatggatggagctacagatcattatcctaagtgaaataactcagaaacaggcaatcaaatattacatgctcttacttataagtggaagttaagcaatgtgtacacatggacataaagatgtaaataatagacactggggactccaaaagtgaagaggatgggagagaggcaagggttgaaaaactaccttttcggtactatgttcctatttgggtgacgggttcattagaagcacaaacctcagcattatacaatatacttatggaacgaacctgcacatgtacttcctgaatctaaaataaataaataaataaataaataaataaatttataaggagctgttaaatacttctagattcaaagcatggaaggcttttctttcctcttccctcctcatgcagttcttactctgactctactcactgctattttacagtcagttcgaacaagcaaagctgacttcccatcccacaaaataaaagattcagcaaatcaccagggagtgagaaattcctatagaccagccagtgaaaacaaatagcagggaactgaagtaggtgtgacatcagcaaggtggcagaataagagttttctactctcatctccccacagtgaacaaattctgataaccacccatggatgacagtacctttgtggaagtgtgggagtcaggtggagaagttctagtttgccactggagcaaaaaaatctgaaaacagacaaagagaaaaaaacaaataccatatgttctcacttacaagtgggagctcactgatgagaacacatggattctgggagaggaacaacagacacgggggtctacttgtgggtagagggtggggtgagggagaggatgagaaaaaacaactatttggtactaggcttagtacctggatgacaatctaacctgtacaacaaaccccatgacactagtttacctatattataacaatcccacacatgtattgctgaacctaaaagaaagaaacattttttgaaagttcccaaacagtttcaacccaaagggaacttcaccaagacactttataatgaaattgtcaaaaatcaaagacaagagaattttaaaagcagcaagagaaaaaagacttgtcacatataagaaacatgccataaaattatcagcagattaataacagaaaccttgcaggtcaggagagtgtggaaatatatattgaaaatgctgaaagaaaaaataaaaacttcctctgaaggatgctttatcagacaaactgtccttcagaaataaagatggataaaaacttacctagataaactaaatttgaacgagttcatcaaaactagatctgccttggaaaaaatgctagactgttcttcaacttaaaatgaaggatgctaattagtaatataataacagaggaaagtataaaactcacgagtaaaggttggtatatattaaaattcagaatactcaacactcccaataaaaagtgggcaaaggactgtaatagaaattttttcaatgaatacatataaaggcaacaagtgtatgaaaacattctaagtattgcttatcatcaggtaaatgcaaatcaaaccgcaatgagatatcacctcccatctattagaatggctattatcagaaagatgaaaaataacaagagtgtttatgtaaatgtactgaaaaagtaaactttgtacactgttggtgggaaagtaaattagtactgccattatagaaaacagtatggaggttcctgaaaaaattaaaaatacacttccgtatgatccagcaatcccacttctgggtatacagccaaaggaaatgaaatcagtatcttgaagagatagttgtactctcctgttcattgtagtgtgattcgtaacagccaagatctagaaataacataaattcctagacataaacaaatggataaagaaaaggtgatatatatatgatggaatattattcagccttcaacaatagggaaattccttcattagtgacaacatagatgacctagaggacattttgtttaacagagaagccagacacagaaagacaaatattgtatatcacttatgcatgaaacttgaaaaagtcaaaatcatagaaacagagtataatgatggttaccaggggctggggggtagaacaaatggggggatattggtcaaagggtacaaactttcagttacgaaatgaataatttcaggagatctaacatacagcatggttactatagttaacaatatctatgataattgtataaataaaatttattaagagtatatctactatctgaagtattctcaccagacaaaaaaggtaactatgtgaggtaacagctaagtcaataagcttgattgtggtaatcatttcacaatatatgcatgtatttaataatcaacattgtataccttaaatatttataatttttatttggcaaaaaataaagctggaaaaaagacataaatacaataataaacataaaattgaagtagtgatcaacattttcaaacaataaagaaaatagaaaacagcagtgatagttaataaactgacgggaagggtgaagattaaccaagggaaggctacatattcagagaaaacaaatatttttaaaacagacatatgtggccaaaaaattctaaatattttgatagttcctgtgggcatcactgacatatagtacaacataatgatagatacaatgtcatataataattgacattacttacttaccatttctcataactgaacaaacaggaaatggtttagataatttctaccacgtcacggctattatgaaagtttgtctatatgacatgttaacatttgtttttctcaaatatattaataaagaattggacattgcaacccatacattagtattaaatagagctacagtatgagaaagaacaaagcattcaggaacaaagatggattaaaaaaattaaaggagagttttcttctcctttatctgtctatgcgataaaaaaattttacttgggggaaatttattttggtattttaaattttctttctggatatttgtttgttagttttcaagtactatcagaagcatataacttttaagaataaagccaaggtcactgaaacagtttgcaaaaaaaaaaacaccgtgtgattgactatctacttggggagcagcatctgtttttgttgtgggaattctctgccttgcacataactacaaaactctatctactacccatgtcttttttggatttagcattaacaattggtcaaacagtagaacaaaaattttaaaacactcttcagttgtttttcaccccataaatccagactttcttctctattgtgctatttctcagaaaggttgcataggttacttctaagtagacatgcattgtattcactatcaagtagcctacaatgtgcttaaaaacatccacacttttaaattgtaacaacaaatcaagaaaaaacttctactgatattcaactgaaaaaaaaagaataagaaaaataaatttaaaatgagaaagtaaacaggaaaaaattacagattcctaaatcaagaaaaatcagaatgtatcattaaaacgttagaagaataaaggagatgagatccatgatgtagactgagcagcttagaagaaagaagctgaataaatctaaggtatcttaaaaaaatactttcatggctgcttatgacttggaatattttcttcttggctgggggaaaatgcatttttaaagccttatatgtaaaccagaacagtcaatttcctaagaactactgatagaaaataaaagtataagtagtctttcagaggcttgtacttctaaagtaaagagcttgtaagtttagtaacatatacatgtttaattactggtattccatatgcagggttggctgctattactaaaacactctgtacagagatttgctaagatgaaagcacacataataattatcgttatcacatgctgagtgccctcttacaccacacttcacagacattctctctaattcataaaacaatcctgtaaaataggaattatcattagtcccattatataaattaagaaactgagactcagagaagttaaataacttgcatatgattatgcagttaagtgatggattgaagatttaaatccacttcttttgtatggcttttaatacttgactccatatgaattggttttttgcataggcagacattttaaaatgtcctagtttatttactatgggcttacctcatcatcattcataaaatatttttaactgtctattttttaatggacattgttctatatgttgagaatacagcagcaattaagacaatgttccgaacatcatggaccagaaaattagctattactcacagaggaacagatcggcaaattgaccagggtcagctaatttgttcccaaactttgttttatttttaactttttgctttgggcaggaaactataagatagagtataacatgaggcttcagcatgcaggattgccataaccacagtggtcctcacatgtgacttgaaaattacatgaaaaatatgaatgatagactgactctacaccgtgctgtcacctggatataaactctgttcttggcatgtaagtccctccttcagccctgacatttctccaggaaattctttttttctccagatttatgatgctgtgttctctcttcccctcttcataactcttaaattccacaaggcaactatctaattaattcatattttataacacaaatgacttaacactatccttggattatatctctctggacagtacttattttatcaaatggaattgatttataatggattggatttagagataacatattgaggcatgaagatttcctatctcctttattctgcttagatacgactggcatgtacaaagttactcttccatagctaactttcaagaaaggcagggtcacaccacttgagaacatccaatacttgacattattttttgaaatccagtacaaactgatctgtgaagcataacaacaaggccgctcttcatggtctgctcttgtcctaaagcacaagcaattggtgtgatgacctcaataagttatataaaatccacctgcagccagaaaaatttgaaattgaaggatttaaggggaaatggagacatcttcctttcagcgctcttgaatagcaaaatgtcccgtgattcattcatccttttatgtgaaggggtctgacagtgactttagtccaacagcttccagacaactactccgcgtatattagactcatatctgaatacttagtgcaataattgaattccaataacctctgcaagctaaatatattgcctttattcaaggaacactagaaattcactgtaacagtgccctttggagttcataatttgagatgtccttcaaagtaagattgctttataaagatgccattttactgcctaagtaactaaaccttcctggccatgaaccaagacagagtcatggcatttaatcttattatgcatattccacagcttcatatacacaaaggtgtattctgtggcaagtttttcaatatctattggcaaaatatttgcagaaatttatttttctatttctaggaactaactggattgattctgtttcaagtgaaagaaccaaggacacacagtaaaagctgaaggcaatcttgaatttgaaattaaatctgaactttatgtcagtcacataagtaaagagaaggtttcagcaattatttaatacacttatccggttcagaaaataatccagattattgaagtatacatgaaatttccttcagctttgctattttttctgtaccaagtgaaatctttacatgtatacactaattgcatatttaattataattccacttcatcttagcaactttaaattaaatgcaaagaccctaaagttggctacagagtagagctgtgccacctcaaaactccattcaaccacacaataaattcctgtaattatgtttttaattaaacaaaaattccctgaattttacaggaatctgtcaacattcacatcaaaatgtactgcaggaacatgactattttcccgaacactatatagtattaaatgtcataggccttatactttcaagtctttttgtcacattacagttttctgctaggagctaaaatggtatatgagctggttttatagccagaaatagtcgtggcaaggttatattttttgatattttattatttgttgttctcaagagtaataagcaattcctacttatatttgggaagtcagaaaacagatgaaccacttacctgacaaattaaatgtgaaaataaagaatagactgcaaatcttttaaacactcatattttgatgttaaaatattgcataaacaacaacttttcattaaaaaacaagaaatgcacagtatagaagaaaaactaagaaaaaagattaaatttagatgagaggcagtcagctataatatccaaatttctaaattttaaaaaatgacaatataaaaattaaactggctatcttcacattaacaatggctcccatgattcactgatacttgatgaaatactgatctttatatacaaatcagacatcgaaagaatgtaatgtaactttcactacagacttctaagcctaatctatgagtatgaatgtgtgcttgttagcatgtgagtgtgtgtgagaaactgaaaaatagttactaagactcaactgtggatgcacttcaaagcacctactccccaaaattgtgtgttaaatttaacatttgcaataattgaattccagtaacacctttggatctgaaaacaggtaaacagttttcatcagatcctgaagggaatttgtcacccacccaaagtgttagaaaccacttcaaatctcagccatttgtttccatacagtcactgtttagtgtgtcattccatcttgtaagagagctactagtcttgcaggttgagatctaatgttgtctatgacactaatgttgttttgtgcttccacagtagctgctctttatgtttttagtacatagttattgaagccaaaactgatggtgcaggggagaactggatgaaagagcacatttccgggagattactatgaagaggactctatattttttccattattattatttttttcaggtgaatatttgaaagctattcactgtaaccccgcattcacagattttaagattttaggaaatggtaacacaaattctcagaatgttccctgagaaatatctgaaatcaatctgcacaaggaatcaaaacatccaaattcaaatcccagcttcatctctagttgagggacataaggcaattcactcaacattctgggcttctcactctcattttaaaaagaaagtggtttgttccatgatctttaaaccctgtttttcaaatttaaaatgcattgcagtactattcacaatagcaaagtcagggaatcaagctagatgctcatcaatggtggactggataaagaaatgtgatacaaatacatgatggaatactactatgcagcttttaaaagaacaaaattatgtcctttgcaataacctggatgcagctggagaacataatccttcatgaaccgatgcagaaataaaaatcaaacaccaggccaggcgtggtggctcacgcctgtaatcccagcactttgggaggccgaggcaggtggatcatgaggtcacgagttcaagaccagcctggccaagatggtgaaaccccatctctaagaatacaaaaattagcctgcgcagtggcgggcgcctgtaatcccagctacttggggaggctgaggcaggagaattgcttgaacctcggcggcagaggttgcagtgagccaagattgtgccactgcactccagcccgggtgacagacagactccgtctcaaaaaaaaaaacaacaaaaaaaacaaaaaacaacacaaaaaaaaccacgttttcactcataagagggagctaaaaattgagtacacatggacataaagatgagaacataaacactgagtacacacagacatagacactggggagtttcgaagagaggaggtgggggcaagggttgaaaaactaacttttgtatactatgcccgctacctgggtgacaggaccactcatacaccagacctcagcaatatacaatttacccatataacaaacctgcatacacaatacacctgaaactaaaataaaaattgaaaaaacaattacagaaatcttaagaatacaaatacgtcttattttggatagataagataggaaactacatttttagaattatcttctgtaccatttgcatggaacatcccaggtctcctaacacacattaatttggatgaagcattttgtatatattataaaattaatgactaaaacacactaaaatgaaagagtatataattatcctcttagccttgaaatacacacacacacacacacacacacatacatatccccccacacagggacagacatagacatgcagatcctcctctacttacaatggggttatgtactgataaatcgattgtaagttgaaaatattgtaagtcaaaatagattaaatacacctgaactcccaaacatcaaagcttagcttagcctaccttaaatgtgcttagaacacttatattagcctacatttgggcaaaatcatttggcaacactgtacgctcatagagtctcaattattcacccttgtgattgcatggctgaccggaagctgcagcttgctaatgccgcacagcatcacaaaagaatgttcaactacgtatcattagacagaggaaagatcaaaattcaaaaatttgaagtatagtttctgctaaatgcattatcacttttgcaccatggtaaactaaaaaaatcacaaatagaaccttcataagccaaggattgcgtgtgtgtgtgtgcgtattcttcaagcgcataacataaatactaatttacaagtaatgtaattttgaataaagatcatgtacaaaacaaactaatgaaagctttgccattatgcagatattccggaataactgaatgcagatattacttaaataatcagacacaaaattagggtataacttgagaataattcttatgataattaataatagtcatacattcccatagtttttaggatttttttgaagcattgtcacatacatcattgtttaaaacatcacaagaatacttcatagtagatattgctatttttttccataggttattggggtgcaagaggtacttgattacatgagtatgttcttcagttgggatctgtgagattttggtgtacccttaacagataagaaaaataagcataaattcttttcaaatgatatttcaagctcacccaaaatagtagagttaagataagaagtggagtcccatgacttcttctaatatttaagaactgcaaaattttttaaatcgcttttgcaaaaattgtaacagtgagaaaattatgatggtgacagagatctgacttaaacaactccatcttgcctttaacccccaaactgcccctggtcattcctgggcttgggccaagctaactttgggagaatttcagtttatagtttaaattttaatagcctttccccaaattaaattgcctttataaaataaaacgccacaaatttagggttatgagacgggcctgaattttgctaaaatgtaggagtatttaaatgattattagctcttgttccagaggtcataagatttgtaacgtccctagtcactcctttaagtaacatcactattatagaatctaagattgatcttttgagttgtcttttcagacttttgcatttctgaaaccagatgacttcactggatgactccactgagacccaagactcaagacccgaccagtcctgtggccctcacgtgtaagtggattcagcccacgagtaccattttccacacccttatgattgcattccccaaccaatcagcagcaaccattccctaacccactgtccacaacactatctttaaaaaaccctagcattcaaatttgcatggaggctaatttgaataataaactccagtctcccatttagcaggctctatgtgtattgaattctttctctattgcaattcccctgtcttgataaattggttctatctgggcagcaggcaagatgaaacttttgggtggttatattttcatgattagaagatcttgcacacagataaacagcaaaatttcaagtcaagataaaataggtgcaatacgcattcatttcttcaaagtgaaactgtataaataaatgccaagtagcacaaggcaatatggagccaatgattatcaagtttttattcttgaggaattaataatcttactgggaagacaaactgtgagcagattttcacccagcagctatgggaacacaaagaaatggaagctttttctgaatggaaaatctgattcaggcttcctagagaaagtgacagcatatgggagaaacaaaggctctcttctgatgatggagaaaaaggaattcctggcagtagaaatagcaggcaatggtgcaggaaagtactttggggcagagtacattcagaaggtgctgaaactttgatgtagctataatgagatattaatggaaggtaatgatgcaagatggggcttaaaagggtaatttatacatgatgaagaagggtcttgctgccaggctaagggttttaaaccacattccaaaggggaagagtgccaaaagcataaagactaattctgaaatggctctagactgctgcatggagttgaggtggggaggtgggtaatggggtggcagatccagattcagattgcctgtgtgtctcagcagctgtcattcattctctagccagatttaggtaacagattaaatttatccaattaatctttgcctgtagatttttaaatttcagactatgcgcattgtgcaatagcttcataaagattaacaattatttaatgatattatagaaagttctttattttatactgtataattattaattattaatcagaaataagacgtctcttacaagactcaatttataacatggtagtttgtgttaccaggaaaaacagtttccttgctgttaaacaagtccatgtttctaattttaacttaaattagaaaaatatccttcttttattggtcattatagttataaattctgctaaaaccaaccacttcactctacgtacaaagatcaagctttgccttccctaggtttttggtgaatgctaattaacattcctcagtataaccttaactgtgacttgctagttagccctgaaggacaacattctattttaagaaaaatatgtataaattcatggttggtttaaatgcagatgtagcctgttcttgaaagttagtaaaataggttaagcttaggttgttaccccagtcatggtattgcactaaaaactccagggatgccatcacataaatgcatggtagaaataatggatttaagataagatagaataaagatcgtaagatttatttttgtaagatgtaattatttgaaaatcaatatttaaatcataagagctcttttttttttgtttctacagctacacagtatgtgtgaggttcaatctgactatccatcctttatggaaatgctacattacacattaactcaaaggctgagaatccattaagtcaaggtgagaatcctgagaattagcatcatcaattgtgagttttcttttcccttattctaggcctccacgtgaggctttcactattgtccttagtctcttagcccatgataaaaatatatattttataggaatggtttaaggagatgcctttctgagggaggggtaatgacagaaaagtacatccattttttattagtattaaggaaaccgtattggtcattcatcactgacaaaacaatactttgttgctggctgtctattatactaaactgtgaatccatgaaaataaatttctgaaaataataaaaaacatataaaagtcaaatttgagcagtgatggaagtagggtggaagtacaatttagcaagagtctgaagatttttaataattgtgttattttgcatgaaatattatatgattttgctcaagccactggcttaatatattttaatgaatcaaataatgacaaaaacataagggctgccaaactgagaggcaatatataacaataaaattagtggatctggctcttcactgttggctatattctaggcccatttcaacattcagatttagctgaattatttggattccctaatattccttttccagaaataatgatgaattggcttaggggagataagaagaatggtatagcgggagaacaacagtcaagaatcaccattcatactcctgtcaagaatcaatcagttttcttagctagagagggaagcacgagagcacattacatatttgatcatgcattacccaaaaaccatttgtgaagttgggcaggctgtcaacattactcaaatgcactttgggcttttcgagctcaacttttattagatggatgtacatgtgaaaatccatggctttaattgctatagcaaaagaagcagtgcagaatgtgtgtatgtctttgagccacaggaatagaatcctcttcaaaccttgtttcttcactggtatgtccctagtaattggagagatgggtcttgggctaggctaggtggaatatcatataccagtacagaatgcaatccttcaaacattaggacagctaatgtataaatccaaaacttgtataattttagtgtcattagctataagaaaaagccactctctttacaattgtccagcagataacacatcaacaaaacatcatgaaactggccccagcacagtggttttaaggcaaaacacttaaagttacctttcagcaatgtcacaacttgaaaaatacacgcgattctctggtacgaatcacccttgcccatccccctccctcccactgaataaatatagtacaaatcagagatctctatggaaggatcatgctgattaatctatttcagctcttgaccacttgctgtttttggtataaaaatcacttctactgtggggaaaaaagtgacacattaactgtagaaatggaatgttgtatggttatactgtctgctaaatgcactgctaaatccactgagacgcacagcatggttaagggcaccagcactttggcattcaaacagtcctttattgaaggatacaggataagatatatttataatactctgtagatcaactttcaccaagctctgagcagcaataaaggaaaacaaatagggattttgaggaacaaactgagccacgactcactttgacactccaaatactggtatttttcacttagcagtagtgggtaagtattttcctggagtgacagttgaacctttaaaaaaataaacattttttcactgtaaacaaaataaattctggctgctccctagtcactttaaacagatgaataaatcaattcagtgggtgcatagggagagaaacgacagtaacatagtttctcccttcttaaaaactggaagaagatatattgaaggtgatgctatctaaccagtagtgggtaagaaggaagaaattcaggctgttgacattttctggtaagatcttgtaatgaactttagatgttttgctattttgttggttagagtccatctaatatattcctagaagtttcttacagtaagaaaacattgtgtgcatttgtgtgcctctgtgtgtgtgtgtgtgtttaatgcccaacaactgcatctctcacagctaaatttcattatgggagccaaaccagcctcccaaaggtaaaaatttataggagaaacttgaatacctgcagttacacaatgactgactgcactgtttcagctttttctaagtgtatagaaacttttaaaaatcaaatcatccactatgatgatttgatttttttaaaaaggaaaatccaaaggtctaaacccaagattcatgtaaataatatagtaaattgtgatatatatatagaatatatatatagaaagcaacatacagataagtctgaaaggaaaacttacccatgatcagtttaataatatgtcaattatttatgtcatttctcatataaatgccttatatgttcaaaaatagattcttgtgaatagatgctgattataatgtaaatatacataaacacacacacaagaatgcatctattctgctgagatatatttaaaggtttcttgtaatttcaactgatcaatggttttccttcttctgaatattaaataattttctaatgtaaagttacttctgaaaattaattttcataattcatatttattttagaaatgttaaagaagcattcattataagtgtgatatcatcactgtgctacttttcactattttattttttattaatgttagtctaatttttaatctctcaattacacaatgataaacacatgaacattatcttcatattggccctgttactaaggcttccagacactctatgtttgtgagacatgttctgtatttaatgattctgtcctaagtcctatattgagctcatcaggctaccttaaatatcctatattctgctttttattgataaattattttaaaatggctatttctcaaggtgcttaaatgactttgatgaaaacacaagctgaaaatcatgcttccacaagtaaatatctggataattccttatggtctctctagtagtttgagagaaaatcaaaaaggaggattgagaattaaaagtgtttttcatattcgagaaagaaaaagattattgtttgaccaaagactcaaatctgagataacttctaatcagttcgcaagctgtaaaattcagtcaatcaggacagtctcactccagtggccatgcttctgaaaatcagtcattcaacaatggcatcactccagtaaccgtgcttctgaaagttagcaagttagtaaaaatctcaaccttctgaaactcaacctaccagtgacagccacatgcttctacacaagagctgatcagcaaaggtctcactccggtgaccaggcttctgagatccagccatcaataagagctttaatccagtgaccactctaacatagctaaagtccattaatctctaaatactcctgcttctgaaaatccatcaattcttgaacagcagacttccaaaaacttcatatatcagttctgggttcactagggaagattttgccttacaaacgcagctctcctttacagtcaatgaaaagtttgcattagctgtcaagttaaattattattacttcaaacatttgcgaacctttttatggttgaaccttgtttatggttagttttgaattggacttgtgagtgaaaaacataccgatgctttgacttgagattatcatgtttaatctttttaactcctctagttgttagtattatctttttttaatttgtgtatatgtgtatacacaaattatacacagtataattctgtgataaatttttggaacagaggacaatcattaaatgagggaaaaatgcttttgaagttatttgttcagggtacaattgttcagtcaatataaaaaatgctgaaaagatgaaatagcacagaatatagctaaggaaaagagatatataattttctcaactagtaccaaagaaaagtgattaatattaaaactcagaagataaaataattacagcagaagttgtaatggctgtccactatttatatcattagtttcatagctccaatgactgaacatattgctgttataagcattttctgattccaaaattgcaaattttcaagtgtcaaaatgaaattgattgcaaaaattttttaaatgaaaaagttccatttactattatagagattataaaaatctaaatgtctcatctttttcataacgtagccacaatgcaagttatcatacttcagaaaaacatttccctttgattgtgtaatattgttttcatgaaaaggcttgcttagccataaggctactgtaagcaaaactgtttctgataaaacttcagaaataatagcaattttttcagaaatgctcttattcaaattgaagttaataaagaaaaaaatttttcttttatgaattgatggacatactacaaataaacattttggtggatatttatctgaaggtacaaacaatatttattaaatgattaagcaaaatatgaatgattctataaaagatgttggctgttctgcccatattctacataatgctgctaaaacagtagttgatgctgacatggtttgaaaacatcccccaaagttcatgtttttgaaacttaatccccaatgcagcagtatcaaaagttttaaataactttaaaaggttattaggtcatgaaggttcttccctattgaatggattaacatcattatcaatcacacattggtgagagatcatggaagtgggctcttgatagaaaggatggatttggccagatttcaattctttctagtacacccatgtgccttccaccaggggatgctccttgccagattccattgccatgctgttggacttcccagtctccagaaccatgagtcagataagtttctattatttacataaattaccccatttttggtgttttgttacagtagcgaaaaacagatttagacacatgcccttctcattcacactgaagtaattttgataaacttttttcttactttagtatttatactgttcacactgagcaattaaaatatttttgttattctgtttacattcagtattgttcaattctttcacattcaaaaacctgttggctctctttaacaaatgtacttgagag

SEQ ID NO: 465 - DNA, 95 bp, Homo sapiens
tggggtttagttacaatttaaaaaatgctttagcaaagtagcatttaatatttattgacgaaatcattagaaatgagctcctttaaaaattttta

SEQ ID NO: 466 - DNA, 17110 bp, Homo sapiens
gagatcaaggaggacgttaaagtaacctaaacgtaatagaaaatcaattcaaggctgacattttgaaaatatctctctggttccatggtgtagacagactgtgcaggcaccagccggaagataatgcaatcactgaggacagggcactagggaggactctccaagcgataggtggtgccgaagccacaagggaaggaagaaaagcagcccaggactgaacccgggacactcccaccttcagcaggaggcaagcgcatgagggccaagggacacaggctcacagccagcaaggtgggaagaccactaggatactgtgaagttaggagccaagagaatcatccactataacatgacacagtagagccaggtaagttaagaagttgaaactaactactagatctggctgcaccagggtcattaaagagctcgacaaatgctgcttaggacaactgtctacctggactggactcaagagggaatggaagcaaggagacctggactgcactcaagagggaatggaagcaaggagatgggacagcaagcagacagctgaagtgttctacagtggaagatgggctgcccggggtggcttcacctaagatgagagataataccaccttagaaagatggggagtgacccaaccatgcaagaaacacccggcactgcagacagaggacactgaggagcaaagacaatgacaagtgagacgggctctcagggagactggaggttgggcacatggtgttggtaagacacaggccatctgcctccaggtagatggagtcacaggggctaggttaactttccctttaaaaccaccaagaaaccaaataagacagatgaaatgacagttttccagatgtgggacatagagcaacaaaggacatagattcctatgtgacatgaaacttttttcttttttttttttgagacggagccttgctctgtcacccagactggagtgcagtagcgcgatcttgcaaccttggctcactgcaacctccacctcccgggttcaagtgattctcctacctcagcctcctgagtagcggggattacaggcgcacaccaccaggcccagctaattttttttggtatttttagtagagacagggtttcaccatgttggtcaggctggtctcgaactcctgccctcgtgatctgcccacctcagcctcccaaagtgctgggattccaggcgtgagccaccgtgcccagcttgacatgagacattaaagtaacccccacaagtccagcccactgccctgagggaagtcccaggctgtgcccagggagtgggaagtcaggtgggaacccagtgtatggctgtgtggaagagaaaaagagaatgcaggagatagggaggctgattgcataggccagacagcaggaggagctccagagaaccacagggcccaggacccatcacgttgtcagccaggttctttgcaaagcacggatgtgatgaaactacccaaggctcgtggaagaaccacctgaggggatcagaagtataacaatatatgtcattcacgtgcagagcctgaaatggttaaccctccccaccagaaactcttgtgattcccggagccctgcctcggtgataggaacaggccccacacagcaccgtcccactcacacctaacatcttaaaaacaagatatgaaaggatcacactgtttccaagaaacctggctgcatcccagaacaaatatcaaatatttaaagaaatacaaaaatactaagccctgaatacagtaaaactcaatctaaccaaaaattaccatgcatgcaaagaaagaagcaggaagatatgacccatgacaatgagaagtatcaaccaacagaagccaatccagaactgacacagatgttaaaattaactgaaaaggatgttaaaagttatcataactgtattccatatgttcacgaagtcaggtaaggacataaaagttattaaaaaaaaaaaagaaaaaacttatagagatgaaaactccaatgtctgatattaaaaatacttgatgagattaacaacagggtaaacattacagcagactcgggaacctgaagacacagtaacagaagcttcccaaaatcaaacagaaaaatgagaagcacaaccagctgagaggatcagcaagctgcggacaacatcgagcagctgagctcaagtgtaacagcagaccctggtatagtcagccctcaacacagagaaaatctacacacaggagtagagagcaccagaaaccgccatgacatggacaaacacgtatgctgttttgcttgttacagtttcaatctcttttaaaaataactgacttttaaataaaaataaaaacatatattgtcagtttatagcataagtaactgcaaaaggcatgatgaccaaagcatccgggccacgagagaaacggcggcagactgccctgatgctgtgctctatgtgaagcagcacgcagccacctcaaggtagactgtgttagccggaggaagtggagcaaaacgcaaagaaatcattaaaacagcgaaacaaagaagaaggctgctccaaaggaaaacagaaaaaaagggaaagaggaacgaagaacacatgggacaaaaagaaacagaacacgtctagcactcaatcttggtttctgatatcactgtccaatgaaggacccagcgctccttggagaaatggctgattctaaggctgaagcaaggagaaacaaaacaaaacaaaataaccacaaaaaaaccctatgttgatggggcatgtcaaagggagccgaccagaactcctgatggccaaagctagaagaacaatttgagcaacaaaataaagcagtactggattataaccaaaagtataaaacaaacattctggaatccacactgctataaagagttgaataagtaaataaataaaggagaagagacaaatctcccatacataagaattttaaataatttacgaagattcgtgtcctcatggagggggaccataaatccccaactccttaagtgtgggctgtacgcagcgacttccttccaaacagtacaacatggaaatggggagggaaagggtaacttcatagtgagaaacccagtaaacagccaggtgatcaagatcaacaccaacagtggtaagtcacgttgacaatgtgcacccttgatatatgtgataaaagtggtgttttaccttctcaaacccattaccactatagtatcataatgaggaaaacatcaaattctaatagaagagaatgttgttacaaaatacttgactagtactcttcagaactattatatcaaaactaccacaaacaaggaaagcctgggaaactgttacagccaagaggagcctaaggagacgtaacaatgaaatataatgtggttctcagctgagatcccgcaacagaaaaaggacgttaggttacgatgtatcactactggttcagtgattgggacaaatgtaccatattaatgcaagatgtcggtaataggaaaaactgggtgccaggtatatgggaattctgtgtgttcaatcatctcaatttttctaagtctaaaactattctaaaacaaatagcaagatgagagacctaaacctaaccaaagcaattaccacactaaatgttaacgttctaaatagaagacaaaaaagcaaaacccaaatgttatgttatctacaacaaatgcactttattaaatacacaaatagcttaaagtaaaaaggatataagatataccatattaaggctagtcaaaagaaacctggagtgattacattaatgtgagacaaagtaaattgagagcaaagactattactaaagataaagagaggggtcaatgaatcaagaggccacaaaaaagtcttcaaaatacgtgaagcaaaaactgataaaactaaaaggataaacagacaaatgcaaaaattaacagaacctttctttcaatagttgacagaacaagtagacagaaatcagaaagagtacattaatcttgaacactaccactcaacttgacctcattaacactgacaaaatattccccatagcaacagcaaaacacatattcttctcaaggacaaatggaatatttaacaagacagcccatatttgaagccataaaataagacttaatatatttaaagaaattcaagtcatacaaagtatgttctttgaccacaatgaaattaaactagaaattaataaaagaaagatccctggaaaacccccaaatatttgtaaactaaatcaaatatctctaaattatctatgagtcaaagaaaaaaaatcaaaaaagaaatacagtatttggaagtaactgaaaatgaaaacaatgcatctaaatttgagagattctgcttaagcactacttatggggaaaatagtaaaactaaatgactatatcagaaaataagaaaggcctcatattaatgagctctgcttccaccttaggacacagaagaaagggtaaattaaacccaaagaaatcgtaagagagtatattacaaacatcagaagaaagaatgaaataggaaagagtaaaacaaatgagaaaaatcgataaaatgaaaacactaactttttttttttttttttttttgagatggagtttcgctctgtcccccatgctggagtgcaatggtgcgatcctggctcactgcaacctacgtttcctgggttcaagcagttctcctgcctcagcctcccgaggagctgggaccacaggcgcccgccaccacaggcggctaatttttgtatttttagtagagatggcgtttcactatgttgaccaggctggtcttgaactcttgacctcacgtgatctgcccgcctcggcctctcaaagtgctgggattacaggtgtgaaccaccatgcccaacagaaaacaccttttgataaggtcaataaaactaacaaacctctacccagactgattgggattataaagaagacacaaattaccaataacagagatgagtgatgtaacatgactacagatttcacaggtgataacagagtattatgaacaactctgtgctgtaaatcccacaactcagatgaaatagaccaaatctttgtaactatataaaccaaagctccctcaagaagaaataaatgagtagcactatgaaaaaataaactgtagttgaaagctttcccacaaataaaactcctgcccaggtgggacgcagtggctcatgcttgtaatctcagcatctagagaggctgaggtgagcggatcgcttgagctcaggagtttggagaccagcctgggtaacatggtgaaactccatctctacagaaaatacaaaaataagccaggcgtggtggtgtgctactgtagtcccagctacttgggaggctaaggcgggagaatcgcctgagaccgggaggttgggactgagtgagccatgatgatgctactgcactcaagcctgggtggcagagcaagactctgtgagcaactaaactaagtaagtttagtaagtaagaaaggaaagaagaaaaaaggaaaactcctgcccacatgacttgtttcacttcctcatatgagggtgaaataatacgtaacctcttccaaaaacttaaatagaaagaaaaacactgaaatgaaaactagaaaccaagatcccaggtgtaaaaattctaagcaaagttttggtaaatggaatccagtagtatatccaaagtatactgtatcatgatctacagaggtttagaccacaaatgttggtatcacatttgaaaaacaattaatacaattcatccgaacacactaaaaaacaacaaatatatgcccatctccatagatgacaaattacaatattcattcctcataaaaatctctcagcaaaccaggaaaagaagagtgcctcatcaacatataaagggcacagacctaaaaccaccactaacgttatacttcatggtgaaatactgagtgcctcttgtaagaccagagacaacccaaacgtttgttcattctttccacttctgttcacctttgtactggagggcctatctagtacaacggggcaggataaagaaataaaaggcatcaagattggagagaaagtaaaacagtcttcattctaaaataatccaatcatctatgtagaaaatccaatgtaatctacaaaaaagtgtctaaaactaataagtgagcataacaaaatttctgggtttggactcaatacataaaaatgaatgctttgatatactagtaacaaacaactgcaaatacaaattttaaaaatcacttacaatagcaccaaaaaatataaaatacttataaactggataaaagatgtaaaagaccagtacactgaaaaccaaaaaatacttctgagagaaattaaagatctaaacaagtaagagatacatcttgttcatggatattgttcagatgtcaatgttctccaactgatctatagattcagtgaaccccccaacaaaaatctcagcactttgtagatattaacaacctcattctaatttgcatggaaatacacaggaactggaatttaaaaagtaactatgaaaaacagagttggaaggctatcactacctaatttcaagaattattaacagtacaggcatacctcagagatatcatgggttcagttccagagtgctgcaatcaagcaaatattgcaataaagcaagtcacacaaagttctgttttcccagtgaatataaaaattatgagtacactaaactgttgtatatttaatgtgagatagcagtatgtccttaaaaaaaaaactacaataccttcatttaaacatactctattgctggctgggcatgctggctcaggcctgcaatcccagcactttgggaggccgaggcaagtggaacacctggggtcaggagttcaagaccagcctggctaacatggcaaaaccctgtctctaataaaaatacaaaaattagctgggcatggtggcacatgcctgtagtcccagctacttgggaggctgaggcacaagaatcacttgaaccctggaggcagaggctgcaatgagctgtgatcatgccactgcactccagcctaagtgacggagtgagattatgtctggaaaaaaataaataaaaagaatctattgttggaaaatgttaacgatcatctgagccttcagcaaataataatcttttttgctggtcctgccttgatgatgagggctgactgttcaggatggtggctgctgaaaacttgggtggctgcggcaatttcttaagacaacagcgaagtatatcacgtggacggactcttgctttcaccaaagatttctctgcagcgtgtgatgctgtttgatatcattttgtcaacagtgggacttctttcaaaattagtcaatcctctcaaaccctgctgctgctttatcagctaggtttatggaatattctaaatcctttgttgtcatttcaacaatattcacagcgtcttcaccaggaatacattctaactcaagaaaccattttctttgctcatccataagaagcaagttttacacattcaagttgtacatgagattgcagcaattcagtcatattttcaggctgtacttctgattccagttctcttcctatttctactacctctgcagtgactttctccactggtcatgaacccctcaatgtcctccgtgagggctggaatcaacgcctctggttaatgttgacattttggccttccctcacgaatcacaaatgttcttaacagcatctagaatggtgaatcctttccagaatccatcagaggaaccatgatctatacagctagagccttatgaaatgtattttttaaataagaaaatttgaaaacacaatgactccttgatccataggctaccgaatggatgttgtgttagcagccatgaaatcaacattcatctccttgtacacctgtcagagctcttgggtaactaggtacattttcaatgagaaattaaaatctgaaaaatatctttgtttttttttttcctgagcagtaggtctaaacagtaagcttaaaatattcagtaaaccatgatgtaaacagatgtcctgtcatccaggctttgttgttccacttaaagaacacagggagagcaaatttagcatcattcttatgggccctaggattttcagaatgggaaatgagcactggcttcaagttaacgtcaccagctccattagccccaacaagagagttggtttctaatgttgaaaccaggattaacttcttctctttagctatgaaagtcctagataacatttccttctaatataaggctattttgtctcgattgaaaatctgtcatttactgtagccatcttcatcaattatcttacccagatcttctggataacttgctgtttcaccttgcatttttatgttatggagactgcttcttttctttaacttcatgaaataacctctgtgagcttcaaacttttcttctgcagcttcctcacctctcagccttcacagaacttaagagagttaaggtcttgctctggattagactttggcttaagggaataattgttgtgactggtttttctatccagatcaaagtttctccatctcagcaagaaggctgttttgctttcttatcatttctgggttcactggaggggcacttaatttccttcaataacttttcctttgcatttacagcttggttaactgtttggctccagagaccgagttttcagcctatctcagcctttgacattccttgcttactaagcttaatcacttctagtttttgattaaaagtgagataagtaaaactcttcctttcactggaaccctcagaagagggaatgtagggctattaattggcctaatttcaatactgtcatgtctcagggaataggaaggcccaagcaaagagagagagagacaagggaagagccagttagtggagcagtcagaacacacacgtcatttatatattaagtttgccaccttaaatggtgtggctcctggcaccccaaaacaatggcagtagtacaaaacaccaaagatcatcgatcaccactagcattaataataatgaaaaggcttaaaatattgtgagaattatgaaaatgtgacacagagacatgaaatgaatacatgctattggaaaaatggtgccaattacttgcttgatgcagggttgccacaaaacttcaatttataaagaaggtggtagctgcaaagcacaatgaagagtagcacaatgaagcaagctctgctgacaatccaagcagtgcactactggagtcaaagcgggctagcgcatcaatgaacagaacagacagtccaaaaataaatccagacctacgtggacaaacgacttctgagaaaggtgcaaaggcaacgcagcagagagaagtctttcaacaaacagtgctgcaatagctgcagattcctatgcacaaaatgaaaataactttgatccatatttcataccttatacaaaaactaacctaaaatggacctagaaatgtaaaatctaaagcaattaaacttataggaggaatataaaccaaaaggaagagccataaaagaaaaaaatgataaacttgattacacaagaaattttaaactgcttttcaaaaatactcttgggagaacaaagtacattgcgtatctggacttatatccaaaacatataaataactatcaaaagtgagtaataaaacaacccaataagaaaatgcacaaacaggcacaacaccaaataagatatatgcattacaaaaaaatgctgcaacttcaggttctgcatgtgagaagcctgcaagttatcactctggtctgacaagtaaaaaatctaaaaagaacaattaacaactcttcttagatcctacgtaaagtcacaaggcaaacaactgctgccaaattggacagacagacagataaatagagaagcgatcacaacatatggagcagaaacctttgcaggaaccaaggcgaggacagaaaacactgtcctggaactgattaactgctggaggctcagggtggccaagtctgagagttaaaaactgcagggagtctcagtcattggcgggtgaggggttcctgcacttttgtgacttatactttctggagctcgatcaggtcctcacagggaatactagagaaaaatccctttgtgcttccggcacgagtaggagaaaagtaaccgttttgaaaaataccagagcactctgttcttcttaacaaggtctgccctcaggaaagacagtttaaccacagtccaacttgctggggtttaatcagagcagaacatacctagaggaagggaaacacctagctcctgcctcctctggtcatgctgccccacctaagaggggaggaaagaagagaagctcctgtgagcttcacagtccagggcccgggctcactacagacttgagactcccaggcctcttatggaaggcgtcccctgcccacacctcaccccacagcactgaaggcatagtcaccacagtgccttccacccagcacgtcacagctggctctcaagaaagttacaaggcatacacaaaggccaaaaacacaatgtcaagagcagagcaagcattagaaccaggcatgacagagatgtcagaattatgagacagggaatttaaaagaactaggataagatgctaagggctcaaatggataaaggagacagcaggtaagaacaggtgggcaatgcaagcagagagatggaaatcccaaggagggggaaaaaaactgtgagagatgaaaactactgtaacagaaatgcagactgcctttgatgggctattaggagactggacatggatgaggatctatcaacagaaacctctgctggcactcagaaaacaataccccaaaatgaaggcctcagaaacaaaagttttttgggtcttgttttatgtccttgagagcttgaactgtgaccaagtgggagcactctttggtctccaccattgggggaggtacgattttcggatcaggtcgggtggccggtctgaagacaggaacccaagactttttgttctgcatacgtcaagcgctcgggagtttgtcttaataagaggtcccacgtgtaaggggcttttgtcatctcaactcctgctgcctggttagtctgtgtcaacaagagtctttgctgattgagctcattcctgacagtaaatgttttgtgggaggtatctttggaattgcttcttctatgtcctctccaggatctatcctggactttatacaccactgaaaattctaaatgtcaatggccaaaagatggatcctttaaattagaattgtaaatttaaaaaaggattttagaaatctcatcctaaacaactgataaaaacatcaagagcaaaaagggtgcttggcatcactaaccactaggaaatgcaagccaatttctagaaagacccaacaatgctatggttagccttaaaaattctctttaaaattaaagagcaaaaatctgacctgaaacaaaattaaaaattttttaagcttaaactcctactttggatccccctgttggttaacaatgagggctcctctatattcttgtaggcccacagttaaaattccaggctttccctgcggtggcctattagacacacagcccaatgcaacagaagagagggccgagaaagaaatccttgcatacatggccaattgttttttttaacaggcgtgccacgatcgttctatagagaaagggcagtcttttcaataaatagtgcaaggacaactggatatccacatgcaaaaacaaagttggatccatactttataccatatacaaaaattaactcaaaatgatcaaagatctaaatgtaagacccgaaatgataaaactcagacgaaaacacagacaaaaccttcattataataaattcaacaatgttatcttagatatgacaccaaaggcataggcagcccaacaaaaaataaacaaactgaacattatgaacattttaaattttgtacatcaaaagacactttgaataaaataaaaaggcaacccatataatggaagaaaataattgtgattgatgtatctgatcagggattaatacacagaatatattgagaactcctaaagacattaacaaaaacctgattcaaaaataggcaaaggatttgaatagacatttatccaaagaagacaaatggccaataagaacaaaaagggtgcttggcatcactaaccattagggaaatgcaagccaaaactacaaagatatacccactagaatgactactatcaaaaaaatcagaaaataggctgggcgcagtggctcatgcctgtaatcacagcactttggcaggccgaggcagacagatcacctgaggtcaggagttcgaacccagcctggacaacatggttgaaccctgtctctacaaaaaatacaaaagttagctgggtgtggtggctcacgcctgtaatcccagcactttgggaggctgagatgggcagaggtcaggagtttgagaccagactggccaacatggtgaaaccccgtatctactaaaaatacaaaatttagctgggcgtggtggctcacacctgtaatctaggctacttgggaggctgaggcaggagaattgcttgaacccgggaggtggacgttgtagtgagctgagattgctccagtgcactccagcctgggcaacagaattattccatttcaaaaaaaaaaaaaaatcagaaaataacaagtattggcaaggatttaataaaactggaacccttgtacactgatggtgggaatgtaaaatactatggcctgtatggaaaactgtatggtgattccaccaaaaaaagttaaacataagaattaccatatgatccagaaattctacttctggaaggcagttcagcagctttctacagaactaaacatactctgaccttatgatccagcaatcacactcctgggtatttacccaaaggagttaaaaacttccttccgtacaaaaacctgcacatgaatgctaacagcatctttatttgtaattgccaaaacctggaaacaaccaagatgtccttcagtaggtgaatgactaagtaatttgtagtatgtccagacaatggaatgttattcagtgctaaaaagaaatgagttatcaagccttgaagacatggaggaagcttaaatgtacgttactaaatgaaagaaacctatctaagaaggctacatcctgcaggattccaaccctatgacattctggaaaaggtaaaactatggagacagtgaaaaaaccaatggatgctaggggttggggggagggaggggtgagtaggcagaacacagatgacttttagggcagggaaactactctctctgatgctacaatggagggtacatgtcattatacatttctccaaacccacagaacgtacaacaccaagagtgagccctcatgtaaactgtagactccaggtaataatgatgtgccaatataggatcatcaattatacaaaggcaccctctggtgagggagtgtgaatagtgaagaaggccatgcatgtgtgggggtgggggggaggggagtatatgggagatctctataccttccactaaaactcgctgtgaacctgaaagtgctctaaaaaaaacagtcttttttttaaaaaggatgtttgatagcattagtccttagggaaacataaattaaagccacagtaagattctactgtctcccttttacagcagctaaaattaaagactgaccctgaggtcataagggtcataaggatgtggtgctttaatccaccactggttgagaatagaaaatggtaccaccactttggaaaactgccttaccatttcttaaaaggataaacatgcctaccagatgatccagctactccattcctaggtattttacccaagagaaatgaaaacatatgtttatatgaaatcttgctgacaaatgttcacttttatgaacactttttattggcaaagccacattttgaaaacaatcccaaaatccatgaataggggaatagaaaaacaaactgtgatctatccatatcatgaatacttctcagcaataaaaataaatgattaattcatgttacaacatgaatcagtctcaaaaatagtaacctaagtcagacaaaaacagtacacactgtcaaattctatcacacgtctgttgtccagcaacttgtggggctgatgcacatctcttgggcccaggagttccatctttttttttaaagagaaaaaaaatctacgaaacgcaaactgacatatagtgatagaaaacagaccactgggccgggcatgaaggcttacacctgtaatcccagcactttgggaggccgaggtgggcgggtcatgaggtcgggagatcaagaccatcctggctaacacggtgaaaccccgtctctactaaaaatacaaacaattagccgggtgtggtggtgggcacctgtagtcccagctactggggaggctgaggcaggagaatggcgtgaacccgggaggcggaggttgcagtgagccgagatcacgccactgcattccagcctgggtgacacagcaagactccatctcaaaaagaaaaaaacagaccaccggttccacggagaaaggagagggcacaggaagctcttcctggtgtttgggatgttcgtgatcttgattgtgctgaggattttacaggtacagaacaacttatcaaactgggtggacaaagcaaagaggaatgaaagaggcaacacattaataatgtattatttcctcaattgtctgtaagctacagaaaatctggggtatacctgaagtatatgatgtttattgtacatcggttatgcctcactaatgctttataggagtgagagagggagtaggtggaggcagatgaaggaggaagacaaagcagaaggtattctttttcttctttttgaaaatagttttaaataccccttttaaaaagaatcaccttttgaaattaaactttccagaatatactttaacatgttgttatttcacttttgataatgttccctatcttctatcttcagatagattttaacatgttatttcacttttggtaacgttatctatctcctgtcttcaggcagattttcacaagttatttcactgttgataacattacccatcttccatcctcaagacagatcttcacatctgtctacctcctatctatcttccatcttctgtataaattctgaccccagttcaagattaggtcatttcaatttagtctgaaacttaaattgtttattttgaaccattttacttcctaccattaggattctcactccctcaatgtataatgcctttttatcttttgtaaaaatctgttttaatgatgagcattcctttcctttgccatcttaaattcaatggactctaacatgactccagtttatcccaatgttctgccattcccaagtcactaaccagttactggtgaattaacaagggggatgtaatcaaattacattgctgaatactggccttcctcagatttagaaaactgctcatgtagacgggaaattcactttatgcaaattcaagatggcaaatttatatttacaagaaacaagcatggcttaatttttgtacctttataaatacttgattcattttaccaaacaattatttaaagcaataagctccactgaagttaaaaaaaaaaaaaaaaaaaaaaaaacaaccgtcacagaacatctacacattttccctcttaagtgacagtttctgactttgacagtcttaagccaatgaagtcattctgcatggctgtgccttacagcatcgaggtctggcctctccagccctgcccagtgcattccctggtcactgggataacgaaaagcccatggcaagtggggtgggggaggggacagggactggttaagaacaattgtggtaataaaaatgaaaacatgagaggccgaggcgggcagatcacaaggtcaggagatcgagaccatcctggctaacatggtgaaaccccatctttactaaaaatacaaaaaattagccgggcgtggtggcagacgcctgtagtcccagctactcaggaggctgaggtaggagaatggcatgaactcagtaggcggagcttgcagtgagccgatgtctcaccactgcactccaggctgggtgacagtgagactccgtctcaaaaaaaaaaaatgaaaacatgaaaaagttcctgcatttccagtaacgtgtggtacactccataactgggcctgaacatctcctttcccacctactctcttcctttccgttttttagccactactacatactaaggtacttacaaccctacatgagaacaacagagattctatccagatggtcttacatttgctttcctccaagccattctttcacactcctgcaaaatttaccttccccaaacaacttattttcttcatgtcactcatttcctcatcaacaggaaagaagttcaaatgtgaatggcttctaagacttgcaaatggggcctcaattgcccctacctacaataccacagcattccctctctatccccctccctttacccaaactgtcttactctcaaatccaacattaacgttccacctctgcacttttactgacacttcgcactactaaataggtttcatttttttttttttttgagatggagtctcgctctgtcgcccaggctggagtgcagtggcacgatctcggctcactgcaagctccgcctccaggttcacgccattctcctgcctcagcctcccaaatagctgggactacaggcgcccgccaccacgcccagctgattttttttgtattttttttttagtagagacggggttttaccgtgttagccaggatggtcttgatctcctgacctcgtgatctgcccgcctcggcctcccgaagtgctgggatgacaggcgtgagcccccgcgcccggcccaggtttcatcttttgagaccttacattcctccatggcacctccctaaccagggcctctcatcttctctgcatccacataagggtgagtttaaagtagaattaaaagcaggcaaagaaagacccattgtgtagagaatgttaatactctaaataaaaaaaataaataaagcagcccatattccctggga

SEQ ID NO: 467 - DNA, 12290 bp, Homo sapiens
aaaggaaaacagaaaaaaagggaaagaggaacgaagaacacatgggacaaaaagaaacagaacacgtctagcactcaatcttggtttctgatatcactgtccaatgaaggacccagcgctccttggagaaatggctgattctaaggctgaagcaaggagaaacaaaacaaaacaaaataaccacaaaaaaaccctatgttgatggggcatgtcaaagggagccgaccagaactcctgatggccaaagctagaagaacaatttgagcaacaaaataaagcagtactggattataaccaaaagtataaaacaaacattctggaatccacactgctataaagagttgaataagtaaataaataaaggagaagagacaaatctcccatacataagaattttaaataatttacgaagattcgtgtcctcatggagggggaccataaatccccaactccttaagtgtgggctgtacgcagcgacttccttccaaacagtacaacatggaaatggggagggaaagggtaacttcatagtgagaaacccagtaaacagccaggtgatcaagatcaacaccaacagtggtaagtcacgttgacaatgtgcacccttgatatatgtgataaaagtggtgttttaccttctcaaacccattaccactatagtatcataatgaggaaaacatcaaattctaatagaagagaatgttgttacaaaatacttgactagtactcttcagaactattatatcaaaactaccacaaacaaggaaagcctgggaaactgttacagccaagaggagcctaaggagacgtaacaatgaaatataatgtggttctcagctgagatcccgcaacagaaaaaggacgttaggttacgatgtatcactactggttcagtgattgggacaaatgtaccatattaatgcaagatgtcggtaataggaaaaactgggtgccaggtatatgggaattctgtgtgttcaatcatctcaatttttctaagtctaaaactattctaaaacaaatagcaagatgagagacctaaacctaaccaaagcaattaccacactaaatgttaacgttctaaatagaagacaaaaaagcaaaacccaaatgttatgttatctacaacaaatgcactttattaaatacacaaatagcttaaagtaaaaaggatataagatataccatattaaggctagtcaaaagaaacctggagtgattacattaatgtgagacaaagtaaattgagagcaaagactattactaaagataaagagaggggtcaatgaatcaagaggccacaaaaaagtcttcaaaatacgtgaagcaaaaactgataaaactaaaaggataaacagacaaatgcaaaaattaacagaacctttctttcaatagttgacagaacaagtagacagaaatcagaaagagtacattaatcttgaacactaccactcaacttgacctcattaacactgacaaaatattccccatagcaacagcaaaacacatattcttctcaaggacaaatggaatatttaacaagacagcccatatttgaagccataaaataagacttaatatatttaaagaaattcaagtcatacaaagtatgttctttgaccacaatgaaattaaactagaaattaataaaagaaagatccctggaaaacccccaaatatttgtaaactaaatcaaatatctctaaattatctatgagtcaaagaaaaaaaatcaaaaaagaaatacagtatttggaagtaactgaaaatgaaaacaatgcatctaaatttgagagattctgcttaagcactacttatggggaaaatagtaaaactaaatgactatatcagaaaataagaaaggcctcatattaatgagctctgcttccaccttaggacacagaagaaagggtaaattaaacccaaagaaatcgtaagagagtatattacaaacatcagaagaaagaatgaaataggaaagagtaaaacaaatgagaaaaatcgataaaatgaaaacactaactttttttttttttttttttttgagatggagtttcgctctgtcccccatgctggagtgcaatggtgcgatcctggctcactgcaacctacgtttcctgggttcaagcagttctcctgcctcagcctcccgaggagctgggaccacaggcgcccgccaccacaggcggctaatttttgtatttttagtagagatggcgtttcactatgttgaccaggctggtcttgaactcttgacctcacgtgatctgcccgcctcggcctctcaaagtgctgggattacaggtgtgaaccaccatgcccaacagaaaacaccttttgataaggtcaataaaactaacaaacctctacccagactgattgggattataaagaagacacaaattaccaataacagagatgagtgatgtaacatgactacagatttcacaggtgataacagagtattatgaacaactctgtgctgtaaatcccacaactcagatgaaatagaccaaatctttgtaactatataaaccaaagctccctcaagaagaaataaatgagtagcactatgaaaaaataaactgtagttgaaagctttcccacaaataaaactcctgcccaggtgggacgcagtggctcatgcttgtaatctcagcatctagagaggctgaggtgagcggatcgcttgagctcaggagtttggagaccagcctgggtaacatggtgaaactccatctctacagaaaatacaaaaataagccaggcgtggtggtgtgctactgtagtcccagctacttgggaggctaaggcgggagaatcgcctgagaccgggaggttgggactgagtgagccatgatgatgctactgcactcaagcctgggtggcagagcaagactctgtgagcaactaaactaagtaagtttagtaagtaagaaaggaaagaagaaaaaaggaaaactcctgcccacatgacttgtttcacttcctcatatgagggtgaaataatacgtaacctcttccaaaaacttaaatagaaagaaaaacactgaaatgaaaactagaaaccaagatcccaggtgtaaaaattctaagcaaagttttggtaaatggaatccagtagtatatccaaagtatactgtatcatgatctacagaggtttagaccacaaatgttggtatcacatttgaaaaacaattaatacaattcatccgaacacactaaaaaacaacaaatatatgcccatctccatagatgacaaattacaatattcattcctcataaaaatctctcagcaaaccaggaaaagaagagtgcctcatcaacatataaagggcacagacctaaaaccaccactaacgttatacttcatggtgaaatactgagtgcctcttgtaagaccagagacaacccaaacgtttgttcattctttccacttctgttcacctttgtactggagggcctatctagtacaacggggcaggataaagaaataaaaggcatcaagattggagagaaagtaaaacagtcttcattctaaaataatccaatcatctatgtagaaaatccaatgtaatctacaaaaaagtgtctaaaactaataagtgagcataacaaaatttctgggtttggactcaatacataaaaatgaatgctttgatatactagtaacaaacaactgcaaatacaaattttaaaaatcacttacaatagcaccaaaaaatataaaatacttataaactggataaaagatgtaaaagaccagtacactgaaaaccaaaaaatacttctgagagaaattaaagatctaaacaagtaagagatacatcttgttcatggatattgttcagatgtcaatgttctccaactgatctatagattcagtgaaccccccaacaaaaatctcagcactttgtagatattaacaacctcattctaatttgcatggaaatacacaggaactggaatttaaaaagtaactatgaaaaacagagttggaaggctatcactacctaatttcaagaattattaacagtacaggcatacctcagagatatcatgggttcagttccagagtgctgcaatcaagcaaatattgcaataaagcaagtcacacaaagttctgttttcccagtgaatataaaaattatgagtacactaaactgttgtatatttaatgtgagatagcagtatgtccttaaaaaaaaaactacaataccttcatttaaacatactctattgctggctgggcatgctggctcaggcctgcaatcccagcactttgggaggccgaggcaagtggaacacctggggtcaggagttcaagaccagcctggctaacatggcaaaaccctgtctctaataaaaatacaaaaattagctgggcatggtggcacatgcctgtagtcccagctacttgggaggctgaggcacaagaatcacttgaaccctggaggcagaggctgcaatgagctgtgatcatgccactgcactccagcctaagtgacggagtgagattatgtctggaaaaaaataaataaaaagaatctattgttggaaaatgttaacgatcatctgagccttcagcaaataataatcttttttgctggtcctgccttgatgatgagggctgactgttcaggatggtggctgctgaaaacttgggtggctgcggcaatttcttaagacaacagcgaagtatatcacgtggacggactcttgctttcaccaaagatttctctgcagcgtgtgatgctgtttgatatcattttgtcaacagtgggacttctttcaaaattagtcaatcctctcaaaccctgctgctgctttatcagctaggtttatggaatattctaaatcctttgttgtcatttcaacaatattcacagcgtcttcaccaggaatacattctaactcaagaaaccattttctttgctcatccataagaagcaagttttacacattcaagttgtacatgagattgcagcaattcagtcatattttcaggctgtacttctgattccagttctcttcctatttctactacctctgcagtgactttctccactggtcatgaacccctcaatgtcctccgtgagggctggaatcaacgcctctggttaatgttgacattttggccttccctcacgaatcacaaatgttcttaacagcatctagaatggtgaatcctttccagaatccatcagaggaaccatgatctatacagctagagccttatgaaatgtattttttaaataagaaaatttgaaaacacaatgactccttgatccataggctaccgaatggatgttgtgttagcagccatgaaatcaacattcatctccttgtacacctgtcagagctcttgggtaactaggtacattttcaatgagaaattaaaatctgaaaaatatctttgtttttttttttcctgagcagtaggtctaaacagtaagcttaaaatattcagtaaaccatgatgtaaacagatgtcctgtcatccaggctttgttgttccacttaaagaacacagggagagcaaatttagcatcattcttatgggccctaggattttcagaatgggaaatgagcactggcttcaagttaacgtcaccagctccattagccccaacaagagagttggtttctaatgttgaaaccaggattaacttcttctctttagctatgaaagtcctagataacatttccttctaatataaggctattttgtctcgattgaaaatctgtcatttactgtagccatcttcatcaattatcttacccagatcttctggataacttgctgtttcaccttgcatttttatgttatggagactgcttcttttctttaacttcatgaaataacctctgtgagcttcaaacttttcttctgcagcttcctcacctctcagccttcacagaacttaagagagttaaggtcttgctctggattagactttggcttaagggaataattgttgtgactggtttttctatccagatcaaagtttctccatctcagcaagaaggctgttttgctttcttatcatttctgggttcactggaggggcacttaatttccttcaataacttttcctttgcatttacagcttggttaactgtttggctccagagaccgagttttcagcctatctcagcctttgacattccttgcttactaagcttaatcacttctagtttttgattaaaagtgagataagtaaaactcttcctttcactggaaccctcagaagagggaatgtagggctattaattggcctaatttcaatactgtcatgtctcagggaataggaaggcccaagcaaagagagagagagacaagggaagagccagttagtggagcagtcagaacacacacgtcatttatatattaagtttgccaccttaaatggtgtggctcctggcaccccaaaacaatggcagtagtacaaaacaccaaagatcatcgatcaccactagcattaataataatgaaaaggcttaaaatattgtgagaattatgaaaatgtgacacagagacatgaaatgaatacatgctattggaaaaatggtgccaattacttgcttgatgcagggttgccacaaaacttcaatttataaagaaggtggtagctgcaaagcacaatgaagagtagcacaatgaagcaagctctgctgacaatccaagcagtgcactactggagtcaaagcgggctagcgcatcaatgaacagaacagacagtccaaaaataaatccagacctacgtggacaaacgacttctgagaaaggtgcaaaggcaacgcagcagagagaagtctttcaacaaacagtgctgcaatagctgcagattcctatgcacaaaatgaaaataactttgatccatatttcataccttatacaaaaactaacctaaaatggacctagaaatgtaaaatctaaagcaattaaacttataggaggaatataaaccaaaaggaagagccataaaagaaaaaaatgataaacttgattacacaagaaattttaaactgcttttcaaaaatactcttgggagaacaaagtacattgcgtatctggacttatatccaaaacatataaataactatcaaaagtgagtaataaaacaacccaataagaaaatgcacaaacaggcacaacaccaaataagatatatgcattacaaaaaaatgctgcaacttcaggttctgcatgtgagaagcctgcaagttatcactctggtctgacaagtaaaaaatctaaaaagaacaattaacaactcttcttagatcctacgtaaagtcacaaggcaaacaactgctgccaaattggacagacagacagataaatagagaagcgatcacaacatatggagcagaaacctttgcaggaaccaaggcgaggacagaaaacactgtcctggaactgattaactgctggaggctcagggtggccaagtctgagagttaaaaactgcagggagtctcagtcattggcgggtgaggggttcctgcacttttgtgacttatactttctggagctcgatcaggtcctcacagggaatactagagaaaaatccctttgtgcttccggcacgagtaggagaaaagtaaccgttttgaaaaataccagagcactctgttcttcttaacaaggtctgccctcaggaaagacagtttaaccacagtccaacttgctggggtttaatcagagcagaacatacctagaggaagggaaacacctagctcctgcctcctctggtcatgctgccccacctaagaggggaggaaagaagagaagctcctgtgagcttcacagtccagggcccgggctcactacagacttgagactcccaggcctcttatggaaggcgtcccctgcccacacctcaccccacagcactgaaggcatagtcaccacagtgccttccacccagcacgtcacagctggctctcaagaaagttacaaggcatacacaaaggccaaaaacacaatgtcaagagcagagcaagcattagaaccaggcatgacagagatgtcagaattatgagacagggaatttaaaagaactaggataagatgctaagggctcaaatggataaaggagacagcaggtaagaacaggtgggcaatgcaagcagagagatggaaatcccaaggagggggaaaaaaactgtgagagatgaaaactactgtaacagaaatgcagactgcctttgatgggctattaggagactggacatggatgaggatctatcaacagaaacctctgctggcactcagaaaacaataccccaaaatgaaggcctcagaaacaaaagttttttgggtcttgttttatgtccttgagagcttgaactgtgaccaagtgggagcactctttggtctccaccattgggggaggtacgattttcggatcaggtcgggtggccggtctgaagacaggaacccaagactttttgttctgcatacgtcaagcgctcgggagtttgtcttaataagaggtcccacgtgtaaggggcttttgtcatctcaactcctgctgcctggttagtctgtgtcaacaagagtctttgctgattgagctcattcctgacagtaaatgttttgtgggaggtatctttggaattgcttcttctatgtcctctccaggatctatcctggactttatacaccactgaaaattctaaatgtcaatggccaaaagatggatcctttaaattagaattgtaaatttaaaaaaggattttagaaatctcatcctaaacaactgataaaaacatcaagagcaaaaagggtgcttggcatcactaaccactaggaaatgcaagccaatttctagaaagacccaacaatgctatggttagccttaaaaattctctttaaaattaaagagcaaaaatctgacctgaaacaaaattaaaaattttttaagcttaaactcctactttggatccccctgttggttaacaatgagggctcctctatattcttgtaggcccacagttaaaattccaggctttccctgcggtggcctattagacacacagcccaatgcaacagaagagagggccgagaaagaaatccttgcatacatggccaattgttttttttaacaggcgtgccacgatcgttctatagagaaagggcagtcttttcaataaatagtgcaaggacaactggatatccacatgcaaaaacaaagttggatccatactttataccatatacaaaaattaactcaaaatgatcaaagatctaaatgtaagacccgaaatgataaaactcagacgaaaacacagacaaaaccttcattataataaattcaacaatgttatcttagatatgacaccaaaggcataggcagcccaacaaaaaataaacaaactgaacattatgaacattttaaattttgtacatcaaaagacactttgaataaaataaaaaggcaacccatataatggaagaaaataattgtgattgatgtatctgatcagggattaatacacagaatatattgagaactcctaaagacattaacaaaaacctgattcaaaaataggcaaaggatttgaatagacatttatccaaagaagacaaatggccaataagaacaaaaagggtgcttggcatcactaaccattagggaaatgcaagccaaaactacaaagatatacccactagaatgactactatcaaaaaaatcagaaaataggctgggcgcagtggctcatgcctgtaatcacagcactttggcaggccgaggcagacagatcacctgaggtcaggagttcgaacccagcctggacaacatggttgaaccctgtctctacaaaaaatacaaaagttagctgggtgtggtggctcacgcctgtaatcccagcactttgggaggctgagatgggcagaggtcaggagtttgagaccagactggccaacatggtgaaaccccgtatctactaaaaatacaaaatttagctgggcgtggtggctcacacctgtaatctaggctacttgggaggctgaggcaggagaattgcttgaacccgggaggtggacgttgtagtgagctgagattgctccagtgcactccagcctgggcaacagaattattccatttcaaaaaaaaaaaaaaatcagaaaataacaagtattggcaaggatttaataaaactggaacccttgtacactgatggtgggaatgtaaaatactatggcctgtatggaaaactgtatggtgattccaccaaaaaaagttaaacataagaattaccatatgatccagaaattctacttctggaaggcagttcagcagctttctacagaactaaacatactctgaccttatgatccagcaatcacactcctgggtatttacccaaaggagttaaaaacttccttccgtacaaaaacctgcacatgaatgctaacagcatctttatttgtaattgccaaaacctggaaacaaccaagatgtccttcagtaggtgaatgactaagtaatttgtagtatgtccagacaatggaatgttattcagtgctaaaaagaaatgagttatcaagccttgaagacatggaggaagcttaaatgtacgttactaaatgaaagaaacctatctaagaaggctacatcctgcaggattccaaccctatgacattctggaaaaggtaaaactatggagacagtgaaaaaaccaatggatgctaggggttggggggagggaggggtgagtaggcagaacacagatgacttttagggcagggaaactactctctctgatgctacaatggagggtacatgtcattatacatttctccaaacccacagaacgtacaacaccaagagtgagccctcatgtaaactgtagactccaggtaataatgatgtgccaatataggatcatcaattatacaaaggcaccctctggtgagggagtgtgaatagtgaagaaggccatgcatgtgtgggggtgggggggaggggagtatatgggagatctctataccttccactaaaactcgctgtgaacctgaaagtgctctaaaaaaaacagtcttttttttaaaaaggatgtttgatagcattagtccttagggaaacataaattaaagccacagtaagattctactgtctcccttttacagcagctaaaattaaagactgaccctgaggtcataagggtcataaggatgtggtgctttaatccaccactggttgagaatagaaaatggtaccaccactttggaaaactgccttaccatttcttaaaaggataaacatgcctaccagatgatccagctactccattcctaggtattttacccaagagaaatgaaaacatatgtttatatgaaatcttgctgacaaatgttcacttttatgaacactttttattggcaaagccacattttgaaaacaatcccaaaatccatgaataggggaatagaaaaacaaactgtgatctatccatatcatgaatacttctcagcaataaaaataaatgattaattcatgttacaacatgaatcagtctcaaaaatagtaacctaagtcagacaaaaacagtacacactgtcaaattctatcacacgtctgttgtccagcaacttgtggggctgatgcacatctcttgggcccaggagttccatctttttttttaaagagaaaaaaaatctacgaaacgcaaactgacatatagtgatagaaaacagaccactgggccgggcatgaaggcttacacctgtaatcccagcactttgggaggccgaggtgggcgggtcatgaggtcgggagatcaagaccatcctggctaacacggtgaaaccccgtctctactaaaaatacaaacaattagccgggtgtggtggtgggcacctgtagtcccagctactggggaggctgaggcaggagaatggcgtgaacccgggaggcggaggttgcagtgagccgagatcacgccactgcattccagcctgggtgacacagcaagactccatctcaaaaagaaaaaaacagaccaccggttccacggagaaaggagagggcacaggaagctcttcctggtgtttgggatgttcgtgatcttgattgtgctgaggattttacaggtacagaacaacttatcaaactgggtggacaaagcaaagaggaatgaaagaggcaacacattaataatgtattatttcctcaattgtctgtaagctacagaaaatctggggtatacctgaagtatatgatgtttattgtacatcggttatgcctcactaatgctttataggagtgagagaggga

SEQ ID NO: 468 - DNA, 33338 bp, Homo sapiens
ggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattag

SEQ ID NO: 469 - DNA, 42404 bp, Homo sapiens
cgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattata

SEQ ID NO: 470 - DNA, 41765 bp, Homo sapiens
caaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagcta

SEQ ID NO: 471 - DNA, 19998 bp, Homo sapiens
cgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagg

SEQ ID NO: 472 - DNA, 12674 bp, Homo sapiens
aaaaaactgttgcaaggtttttatgcacctaatttcttgccagaaattcagattcaggtggtctcctgtgaggttgtaaagttcaagagtctttttttttggcagtggtgcaatctccatacgctgcaacttccgcctcccaggttcaagtgattcttctgcctcagtctccctagtagctgggactacaggggcctgccaccactcccagctaattttttgtacttttagtagagatggggtttcaccctgttggccaggctgctcttgaactcttgacctcaagtgatctgtccgcctcagactcccaaagtgctgggattgcaggcctgagccatcaagctgggccttcaagtgtttgcatttttaaaccctcattttgtgattctaatgtgcagccagcactgagaatcattgagttaatggagattgttttggtatctttttactttcactttacaaaaacgcatgttctgtaataaacacaccattaatttgaatgcctttgtccaaattgaatgcttaaattaagaactagactatttgtgtgagatgagatcaaatagtttctagattgagttaagaccttccaaattagctaggctgatgcacctttcacataaagccttctttttttattggtttcagatatcattttacttgaccccaaaattgagatttgagagatttgatagcatttattaactctgagctgagagatcttcaattttatttagggtaacctgtgcattttattaaaaaactatagaaaagcctaaaatggtaggatgattgtccaaagtcacacatctgaggactaaaaccaagcggctctgactgcagtgctttttaagtcaacaatgttatttcttgtttataaggatccatttaggttcagaaggggtcaagtaacccgctaatttctgggtgtataatttgacatttgatcacgttgactcccttaaaattgtcctgccccagacaacataggcagacacagtgatgtagtccttttaatttatatcataatgaaaatattctgagacttttactgatccacctctgttactcaggtagagttgaccctctccccgtctttgtgctatcattgtactttatacagatttgtatcatagcacttgtaacttttcattacatgtagtggttttccagcctgtctgtatctgccagcctgtcagtcgctccaaggtggtgatcatttctaaatatttttgtatccacagagcacaggactataatatacacatggaacaggctttataaatacatgctgaatttaacatcaaagaaacgttagctccaatgctaacatacataaaatattaaactctgcatgggtagatttctaggaccattcactgcagtttttttatagcactggattcccaatgccaaggatacaacaatgtcaacaatagccacttactcaaatttgggtataatatatcttgtgtcgttctctctggtagttccatatgtatgtctgcgtgtgtgcatgcaaagaaagacaatacaagagagaagatgaagcaaggtgcaacatagctgagtgtgatttaaatgaagttaatatttattggtcagagttttctgttaaatatgttaaaatcaggtaattaatttatttggaaatattgtgttcctaattcatgtctgttgtttgctcatttatttaactcccaaagctttaaattaggggccatgtttatcatcaattaaaatagttcattatatttggaggtggagggttgcttaataacatttaagtacaaactacccatgctcaatataattagatctaatgttatgcaaccaacagatcagctagctacaaaaataaaaggggtatcaggaataggtgtcatcatgaacagaaacaaagaggaaaaaacatttcctagctgatacacatgagtgaattgtgaccagggaattcactcatcaggtgaaaagcacatcacatggaagcaaagagaagaaaaaaagtcacatttcagcagagagtcatgggttttaggtaaccatgacgacagctcagtgaaataacagcttctcttttttctttatgaaaaagattttgtggaatgtcatacggtttacattttttcccccagataaacctctaatgctataacaaaatctttgctcccaaaagcttttaatatctggcagtttattgctatttctttaaatttaagagaacagtatttaggttcaccttcctcattaatatatctatttcttctatctccccttttttctttgacttggaacacttgatcgtccccccagcatatgttataaatcacttgcgttgaaatagaaaaaaaacagagtcatcatcagaacatccaggctcaaattctacccctgccatttagtagacgacattggaccagttatttaaaatctttgacctttgttttttccaaagagaaaaaaaatgaggtagaattaccatctatacatgttttgtgtgtgtgctaataggaggattaaatggaatgggaaacagaataatgtagtggaaagagtatagtcttttcagtcacatcagcatgaatttgagtgaactttcatacttacttagctacaagaccctaagttacttaattattctgagacgatttttgtccctaaaattagaataatataggttaaagcattactgtgaagggattcaataagatgtgtttatatggcttgtttaggatctgacctattgtttgagtttcatgtgtggaaataatatatttttaaatgatacatcaaagttagatataataatgaatattcaaacagtgttatacacccaaagttaaaaacaatttggtgacctgcccaatggtcttgttttcaaaaataattatgatagttgtcattattaaacactttacacttggcactatgctaagtgctttatacatgttagattatttgatcattgatagaaacgtataattcccatttacagatgaaaaaacttaatacccagagagcttaagtaacttgcccaaggccatgtaactaatagggtcagtattggaaaccaggtctttctgactagaatcttcatgatcataagcacaatgctaatataatttctcctagcctgcctcctctcctgtatgcagtgtaaagactaaggtttggagtttttcaaattatttctggaaccagggtagattttctcctcgttagtaatacctccagtcatccgaacacttagtcacttggcagttggcatttcagcaaaaatagtttcattcaagcctctctaatttaactgagttggctgtaggagtctttaaggcagcaggatcttttgaaaatatcctgagattactcaaagaggaataaaaatgatttagtctacatacttgtagcgtccagttaacccaaattataaaagcatccaacatattacattcaatgtaaaagttaggttagttttattcaaccattcctaagccattaacacgtcataattaatgtagtgggtattgcttcagaataaggaaacttgtgtttcagtgctttggttttgactctaaatatcatatggccctaagacaagtcactcaacagttctagttctcaattatatatggataaaaggatttaggaacgttatgaggtataaggcaaactagaaactggcatttgttgaaacagaaattatttgttgaatagtttcttttcgtatattatgtcatagtacagtttaaaaaaattgagatttagcaagtctaaaaaacatgttcattgccagtaagaaaattagccagaattgaagttgcatctacctgtattacggagcccaattttttctctaccacacaatgcataaattcttaagttatgtcttagtgaccaaaaattaagagtaggttctctaagcatttcttatctaacacagtagcagccatctatggtggggggactgcccattcaattctatttgagatgactacatttgtttatacatgcttatagatagcaaattcagtgggataggaggaccaataaaatagtcttgattattttcaaatgtgatgcaaacagttgaccgggaagacattttaccttcaaattattattctatacgtctcgcctactgttcacaaaattataaatcataacatgggtctttatatcccgttagccttttgtagtcttccacagtctggcttagtatcctcatcatgaaaatagagataaaatcataaaaatccacagggtagttgtgagaatttctaattttaatgtatatggagatatctcccttatggcctaggacagagtagtgactcaatataggtttaaaaaaataagttctagaaatatattctatggtaaaggtggtaccaacaacatgaccaagaaaaatgagcactcaacacatactttttgtaggagattctttggctcatccactgactctgttcattcatccaacaaattcttactgcacatcaacagggtgctagaaactgtactagattctgagagaaaagaaataaacaacaatgtgaaaataaatgtgtcttcatgaaggatgcgtttttataagggacgtaacaatcattgtttattagagacgaaaatgagtaagtgtaagttgggtaaagaacaatgttatctccctagtggccccaagcctcccacggaagcatgcacctgttgtgaacagtcaatgacggcagggtggactctcctgaatttcatcttttgcttcgaatgtatctctcactacctaattactctattttattaaatctaaggtatcaatgaatttaagtgatgcattcatttatgtaccactaagaaaaataaaaaaatatatttatcttaaaagccctttttggcttacgtagtcacatatttttatcatagtttattcttctgcctccatataaatgaaactacaagaaaaataatttggtgaaggattcctgaaatgtttttacattcagagtcagccccttttgagttacttttaaagtcagagtcaacaatgcctgtttttactaattatttgctttggccttaaagaatgggtaggatattagatgcatggcaaagagtgggcatgcttagccacaatcagagtcatggaatggagaagcacaagcagtgtccagagaaagtaggccatctgactttagcagcaggatcacacaggatgtgagcacatggagaatggttgcctgactcgagatattttttggaggtagaattgccaatataaaagcagtgccatcgcacaatgctccatgctcagaagcagaccctacatttgaggtttaatgatctgtggtcttggtgttgaaattcttattaatcttatctttgggtttgtgctttataagtgaagttatagggacaatggagcatatgcttggttcatatgcatcctgcagaccttttgttctttgttttcctgggatgggtcttggctaccactacccatccaccagccctacctagtttccacctcctcaccctctgcccaaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcagccagtattatggactgaattgtgtctcccaaaaatgtgtgtgttgaatccctaatttccagtgtgactatttggaggtaggtctttaaggaagtaattgaggttaagtgaggtcattaacagtggggtcctaatccaacagtactgatgtcctcataagaagacaaaaaagacagagccatctctttctttgtgtatgcgtagagaaacggcaatgtgaagacagagaaaaggtttcctctgcaagacataagagaggcctcagcagataccttgatcttggacttccaaactcatgaactttgagaaaataaatgtctgctgtttaagccacccagtctgtagtattttcttatggcagcctgaactaatctacccacctactcaaacaagtcttagcatggaggtttcaatccctagggagtcacctattcactatagactgagactgtgggatacctattccctgtagattgagaaagtgaatattgatttccctacccccagccaaggcctcaacatttatctggtgctgcaaattgcatagccagtcctgcctagagcaccacaatatttacaggtaagacagacgaggaagagctagtaggacacaccaagtagtaacagcaagagagaaaggcaaaaatcaaaggggatgtgattatagaaatcagtacatagaggaatgtgttttgtgaaaatgaaagtggtcaactgtgcctaatgctatcttaacatggggacttgcagggataattggattttataatatggagtctttgaaggttcataacaaactcattggccaagagatgacaggggaagatgactagagtgcctttatgtgggaatgggtagccaggaaatggaattttcatttaagatacttgctaagatttaagctttaaatcatgtagtctatattcaaatattaactccccccgttttataaactataaatgtttgatgaagccacttaacctctataagcctgttttctcattgatgagatggaaatatcaaaagaactcctctcatagaataattgatttactgttattgaatttcaaaccaaagttttcaaatgtctttgtgtcaggcaccataccattacacaataatacatagtgaataggatacagtttatattttgatagagtttatcacctaacaggtatgtttataaagattaaatatatacaccatattgccttattcattgatttaaaaattcatttacaaaaatattagcactttaagtattgagtattttatgtaacttatcttctagtggagtaggtctagtaagtgtgtgtggtgagacagtaaaacattatatataatattttatttaaaaaagttaaaggagttaaaaaatataataagttatatatattgttttactgtctcacccactcacacttcctagacctactccactagaaggtaagttacataaagtactcaatacttaaaatgctaatacttattaaaaatgtttaagtcaatgaataaggcaatatggtatagacattaaatcttcatgaccatacttattagactgtaaactctataaaaataaaaactatgtttatcgtgttcagtatgtattcttgtattctggtataatgcctgacacatagacattttaaaacttcggtttgaaaagcagcaacaataaatcaatcattctatgagagttcttttgattacatagtttgttagaaggtgctaagtgcacagataaagcagaaattagtggtgtacagtaaatgtttaataacttgttctcaatggaggagtgggaaagtagggagagatgattctgatttgccaattgttgtggtgtaaatactgacaatggtagatttccatctaatgatgggatactgctgaacattctaatattgagaagggttacacactttgaacttttgctagctagtgctaaccagctctacaacactgctaaagtgggtaaggctgaatatgatgttaaatagatgtttagtgtagatttcattaagataatgaagatatgaataacccaagcaggtatcaagggaaaacagtctacccagaaaaaataaccagtacaggaacatgttgcataagagtgattggtgagttttgggaagggcaaagaggccagtgaagttatagaagagagggaaagggaaagatcagtaggaaataatgtttgcatcagtcaggatctcagtaggaaatagatacccaaaccaagttatattaagacagtttatttagaaaaatttgatcaaggtttagggaaaccaacaaagaacaacatcctgttgtcagccacaactgagatacaggactagaactctctattttattttaacctagaacctacttttaaaaattttttaatgttgagttctgctagactagttataaaagcacaaaatacactaaagatgaagttggaaaacttgggttgccatcacaacactgccatttatttgccatataacctgagaaatgccacttaccctctctgagtctcattttccttatttgtgaagcgaaatgtattgttttgtgatgtaaatgaaacaatgcatgtgccgtgttttcttaaaaagttttgcttatagaaaggtgagaaattcttatttttaagacggtatttctacaatgaaaatcaccttggttctagctaaaggatcagagaaatttcttttcttaaaaaacaatcaaccacgagtattgtactgcacatcaaaaaaaaaagggacaataataggatattttatgaacaaaaagcacaaaatgaaactatttctagtccttgacattctgaatataatatagattaatgtttttaaagctactgtttattgagtgttttctgttggtcatgccatgtgctatgggctttatatacagtaagatgcctatctctattgttaccaaccccagcctcagcacttggcacagtgcttaatatataataggtgtttaataaatattttattttctataactatgtgaggtagttgttattatcttcatttgatagatgaggcctagacagttaaatcattttcttaagtggtagatgcaacactagaatcctgttccaggttttaacttttatggctcattctgtaaccttcaaaaagctaattctaaaatacagtagtatgccacacaatggcatttctgtcaaggatggaccacatatatgacagaggtcccacactactataatggagctgaaaaattcctgtcacccagtgacatcatagcagtcataatattatacacaatgcattactcatgtcttcgtggtgatgctggtgtaaacctactgaaatcccacttgtataaaagtctagcacatagcattatgtacactacataatacttgataatgataataaacaactatgttactggtttatgtatttactatctatattttatcattattttcgaatgtacttcttccacttataaaaaagtaagttaactgtaaaacagcctcaggcaggctctccaggaggtgttccacaaaacgcctggatgttttatagagattgttatagagatgatagctccatgtgtactattgcccctgaagattttccagtgggacaagatgtggaggtggaagacaatgatattgacaactttgactctgtgtaggcctatgctagtgtgtatgcttgtgtctcagtttttaacgaaatttcaattatgtttataataagtaaaaaattaaatagcataaagcttataggctaaggatataataaatatttcctacagttgtacaatatgtgttttaagctaagtgctattatcaaaagactcaaaaagttttaaaaaattaagtaaaaaagttacaggaagctaaggtgaatttatcattaaaaaagaaaaatatttttataaatttaatgtagccgatatatatatagtgtttataaaatctactgtagtgtagagtagtatcttaggcctttatattcactccttattccctcacttacttacccaatgcaacttctagtcctgcaaggtccatttatggtaagtgtcctgtatatacaagtatgccatttaaaaaaaaattttatactgtatttttactgtaccttttacatgtttagataggtttagatgtatagatacttgccattatcttacaattgcctatagtattcagtacagtaatgtgctggacagatttgtagcctaggagcagtaggttttaccaaacagccaagatgtttagtaggctataccattctaggtttgtgcaagtacactgactatgatgttcacgcaatgacaaaatcacctaatgatggatttctcagaacatatccctgtcattaaagacacatgattgtagtaatctcctcaggagaagtctaacaacgataattaggagttccaacatttctgccttctcctactgactcagtggtggtgacaatttgtttaacatgagggtgttttgtacagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggtaatctctttcttttcacttttaattttttttctgaattcatatttacagtctcttatccaaagtcctaggaggtatttgagaattcagaattttctgagttgaccaagaatatgtgttgtatatacttatatcgacaatgaccctagctgacactggtcagcacgttataattcaacgtgttagcttcaggagccaggcatggtggctcatgcctgtaatcccagtttacttgggaggctgtgacaggtggatcacttgaactcagaagtttcaggctgcagtgagctatgattgtgtcactgcattccagcctcggtaacaaagtgagagactctgaggaaagaagcagcagcagaagcagaagaagcagcagtagcagctttagtgaaatatatgaatatattcatcatggtaataaatacaggcaataggcaacctaatggtgagtaaagtcagttttttccattaaaagagaaaaattaatttcatttccagaacattttgtattgtggaatttcagatataagtctgtggactgatactattttcctacgttttagtgttttagttttctcctgtttaaaatattctaggcagtgggttctttgaggtaagttcattcatttaactgtaataaggacacagcacataggtaaagcctccctctcattatcccttaagttttctgttcttcatcagagattacatctcatgatcttctctaactcctaaatatttatcctacaaatgttttcatcttgcttgcattttgcattcaaacatcgattcattcttttctgcttatagctgactcagtcatgaaacccatttcactcacataaatttgcattaggaaaacaaaatcacaaacaaacacaacaaaacaaaaacaaacaaaaaaaaactcaatcaagtcacaaatttaccaggagtttggggaagacataggcactgacttgtggcaaggcagacaactcaaaatttaacactagacatcgcagctcctaaaaggcctgtgacaccttaacatgtagaaaaactttcctctcttttgtaatcctttctccttgacttgttctttttttttcctttttgtcattgttttacaccccaacttttattattgtactgtgcagagtggttttactgtttcattcatttccctgttttattcaaaaccataatctcagggtcttacatccagaatcaattgaagcaaggcaagtctcatcctaaagatgaattctgttttccagctatgaaaatagaaattaggtttattcttctatggtaatattcatgattaactttttaaagtaatcaccgtatccaaaacaccatgtcaaacactttgtatggcattaattcactcaattctaataactatcccctgaggaagattgtatttattattcccacttttaagggaggaaacattatcagagatattcatcttttggttattgattcccattgaaaagtggtggagataatctgcccccagctttatcaagtaccaaagtccaagttctttccattgcactctgataatcaacagtgggttgagagtttctttaaagtggacaataccagtttggtcttttgacataagaaggcaagacataatgccaggtaatctcagagcctatataacaaatctaaggtacacaatttcaaagtcaccatctgggaggattgggtgacccactggactcttcagggattaacaacagtactcagaatgctgatattaatgacattgcaaagcgaagctacatctttaaggaaactggagcattttgctgttttttcagccataagtgacaaagcatatattttattattaagaagcatgggttagttgcagaaataaggcaggggaacatcactcgtctagggtctcaagtcaaagaaaaaaagtggctcaagatgtgtcaactcagccagtggttttcaagtgagagtctaatacacacaggtgaggagggaacagcagatttactacaaataatttgctactacaaataatttatgtttgtaaattattttttcccataatttattctcattcttacacactttagtaggcaaagtgtgtgagaagcaaacagatgcaacatagcatattgtctggcacacagtcgttcggtaagtatctgataaccgagtatgtaaataatagctagaatctttcaaattgcatctaaaccaccacttac

SEQ ID NO: 473 - DNA, 1265 bp, Homo sapiens
aaaatgctaatacttattaaaaatgtttaagtcaatgaataaggcaatatggtatagacattaaatcttcatgaccatacttattagactgtaaactctataaaaataaaaactatgtttatcgtgttcagtatgtattcttgtattctggtataatgcctgacacatagacattttaaaacttcggtttgaaaagcagcaacaataaatcaatcattctatgagagttcttttgattacatagtttgttagaaggtgctaagtgcacagataaagcagaaattagtggtgtacagtaaatgtttaataacttgttctcaatggaggagtgggaaagtagggagagatgattctgatttgccaattgttgtggtgtaaatactgacaatggtagatttccatctaatgatgggatactgctgaacattctaatattgagaagggttacacactttgaacttttgctagctagtgctaaccagctctacaacactgctaaagtgggtaaggctgaatatgatgttaaatagatgtttagtgtagatttcattaagataatgaagatatgaataacccaagcaggtatcaagggaaaacagtctacccagaaaaaataaccagtacaggaacatgttgcataagagtgattggtgagttttgggaagggcaaagaggccagtgaagttatagaagagagggaaagggaaagatcagtaggaaataatgtttgcatcagtcaggatctcagtaggaaatagatacccaaaccaagttatattaagacagtttatttagaaaaatttgatcaaggtttagggaaaccaacaaagaacaacatcctgttgtcagccacaactgagatacaggactagaactctctattttattttaacctagaacctacttttaaaaattttttaatgttgagttctgctagactagttataaaagcacaaaatacactaaagatgaagttggaaaacttgggttgccatcacaacactgccatttatttgccatataacctgagaaatgccacttaccctctctgagtctcattttccttatttgtgaagcgaaatgtattgttttgtgatgtaaatgaaacaatgcatgtgccgtgttttcttaaaaagttttgcttatagaaaggtgagaaattcttatttttaagacggtatttctacaatgaaaatcaccttggttctagctaaaggatcagagaaatttcttttcttaaaaaacaatcaaccacgagtattgta

SEQ ID NO: 474 - DNA, 2229 bp, Homo sapiens
aagttgcttgaaattcaacttctcgtatatcctgaactgactaataaggagcaggcttttgggataaaaagtacatacgctgccacctaggaggtgaagcaagatgtggatttttttttcctgtatatggaaatagatgtgggggttcttttgttttatatttataaaacagtcctccctcactcttattccttcatgtgcggtagtccctccccaccatccatgagtttcctttccaaagtttcagttacctgccatcactgtggtgtaaaaatattaaaatggagaattccagaaataattcatggccagccgtcgtagctcacgtctgtaatcccagcactttgagaggctgaggtgggcatatcctttgagcccaggagttgaagaccagcctgggcaatgtagcaagatctcatctctattaaaaatacaaaaaaattagccgagcatggtggcacctgcctgtagtcccagctacttgggaggctgaagtgggagaatcacctgagcctgggaagtcgaggctgcagtgattgtgccactgcacttcagcccagcctgggcaatgggagtgagaccttgtctcaaaaaaaaaaaaaactaaaaacagaaaaccagttcataagttttaaattgcagtgttctgagtagcgtgatgcaatcctgcaatcttgtgctgtccagtctggaatgtgaatcctctctttggtcaatgcatccatactgtctatgctacctcccatgccaccaccccattggtcacttagtagccacctcagttgtcagatccaaagactgtagtatatatataggatatagggttgggtactatctgctgtttcaagcatccactgtggggcttggatcatttcccctgaggataagtgggggactgctgcctctgattttaggcatttcttttaataaggtatattatttttttgtatttgtttggtttattttgagacagtcttaactctgtcacccagacttggagtgcagttgcatgatcactgctcacagcagcttctacatcccaggcttgtgtgatcctcccacctgagcctcctgagtagctgggactacaggcatccaccaccatgcctggctaatttttaaattttttgtagagaccaggttttaccatgttgcccaggctggtctcaaactcctggactcaggtgaaccttaggcatgaaccaccacacctggccaggcatatggtttttgttataaaactaacatttattagagagaatcagaaaattcaggaaaagagaaagggggcctggcgcagtggctcatgcctgtaatcctagccttttgggaggctaaggcaggcagataacttgagggtaggagttcaagaccagcctggccaacagtgaaaaccgatctctactaaaaatagaaggaaaaaaaatgggcgtggtagcccatgcctgtaatcccagctactccttttgggaggctgaggcatgagaatcgtttgagctcaggaggcagaggttgcagtgagccaacatcacgccactgcactacagcctgggcaacagagccagactctgtctcaaaaaaaaaaaagaaggaaagaaaacggaaggaagcaccagattctaccagtgagaggtgtttgaagaaccttgttttcatagcctgtgtgtaaacgtatattttgaaatttaatttttagggaagtaacctgtgcattgatttagaaaatcccttaatactgtaaggtttataaagaaaaagagcaggctgggtatggtggctcacgcctgtaatcccagcacttcggaaggccaaggcgggcggatcacctgaggtcaggagtttgagaccagcctggccaacatggtgaaaccccatctctactaaaaaatagaaaaattaggcaggcgtggtggcaggcgccttaatcccagctacttgggaggcagaggcaggataatcgtttgaacctgggaggtggaggttgcagcagtgaatcgagatcgagcattgcactctagcctgggggacaagagcgagacttctctcaaaaaaaaaaaaaaaaaaaaagcaaagaaaagagcaatgaccctcttttctttatctctggcttgcagcttgcattcttcagaggcaagcactttccactccttctaggtgttttttccgctggtacttttaaaaattccatatttataaaatgtgttacattgctatttcttgaattttcat

SEQ ID NO: 475 - DNA, 6212 bp, Homo sapiens
agttcccaactctaccaatgtagcactttcagatttctctattatgaaaaactgtgaggatttcctaggaaatacctcaagatgggtggagaaaatgccctcttgatcatgaaaggtgatacgtgttagaggaatgtgctaagcaccttccttgaagtggggaaaaatgttcagaagcaagcaaagtgagtagtatagagctgccttaaggtttgcctcttgtgttctcctgcctgcctgtgtaatatctctcagcactgaagatcaaatgagagattgttaccaagaaaaatgagagagctagaaaatagatgtgaaatataaaaatgatgggtaaattacacattgatttaggttttaactttaaaaagcacagagagggtaaagatgtgagaagttgcagaaccaacagggttgaggtgttggtaattcctgctttatgtgctgtaattcagaaactttaaagttttacttttcacctttgaaactgagagacagtttacattaagggttaagaccaagggctctggaaatcccatggacctgatttgaatcccaggcgtcatctattgtccatgaaatcttggacaagttactgtatctacctgtattcttcacttagaaaaatgagataataactcatagggctgttgtgagcattaaatgacagaatccatatcacatagttaaaatgtattattaatagtgtacagtgcctggtataaatgtgataaaataaatgtgatctgatattttagaatttaatcagtttgtaatacctggtagccactgttactttgttaaaaatctgttaccacactatctttgaagttatgtttatctctgtaggctttttatcatcaaattgaggtcattggctcttccaagtagttggttcctgattcttctaaaagttctggattattataagatggaaattgtcagtctgaagtcacaatatatgggaaaagactatactaacgggaaacctaatagcagtgaactataacaaagcccaaagtcagagcaatgaagagatagtgtatttgactagttactctcgggcttgtattccaaataccttttttaaaaacttttaaaataaaaacacttattttttttgaacaaaattgctgttttctttttcccatctagaagttcaggtaaattaagagaaatggccctataaaatggaaaaatagtataaggaaaagcataataatctggaatcaatatagccaatccttaagaagcttggtttgttttatatagcttgtggcttgatttatttgatgattaagttcctgaaaaatgataatatggaaacaaccaccatttttcttacttaaaactatggccaatccatttcattttaataaaatatgccaatatggaatatgatgacttaaattttttctttttgaaataaaaaaagtaattcagttataatatccagcttgcaaatggcattagcttgtaattattgtatctactctagtatgggagttcttctgaagtctttgttaaacccagtgatggctgataaaggcactttctaatcatcgctcttgacttagctgcataatgaagatgccactcgtgtcagggcaactaatggctttgattttactctgatggtgagagcctttcacttcgtctccactgggaatcactctgatgttgtttaattccagtcatgatttttacagtattaatttcttcattctttgtttaaagaaacccacattcattatgctgagatgtgggtatataattactttgtttttcagtagctgcagatcagtattttttttaatagtgccacatatttttaaaagattatttcagtttgagtatcatgattatccacagtaactatctaaatctcaaatgtgttgaggagtactgtgttttgtatgcttagttacatgcttgattattccagataaggtaattctttcctgtcctctttgctttactttagagattatcttctaaaaagggggaaacatatagaaactcaagactgttgagtgctcttgacctgatcttagagcacagatatcaaatattttaaaaaatttactagaagcctttgaagtaatcatttgggatagtaaagttcatttacattttgaatgttattaagattttaaggtaggccgggtgtggtggctcacacctataatcccagcactttggaaggccgaggtgggcacatcacctgaggtcaggagttcaagaccagcttggccaacatggtgaaaccccgtctctactaaaaatacaaaaattagccaggtatgatggtgggtgcctgtaatcccagctactcaggaggctgagacaggagaatcgtttgaactcgggaggcagaggttgcagagagctgagattgtaccactgcacttcagcctgggatacagccagactctgtctcaaaaaaaaaaaaaagaaaaaaaaaatttagatccatgagtatcatttctaccagctctcttaataaatgacttattacatattggggcataaaaatagaagtatttgtgttcaacttttcttcagtgattatttgtagatttttggaaactttgctcagctttggagtagagagaatgagaaagagattaaattatttccatttaagaaccagctcaaatgcctgttttattctcttgataagtgttggaatattatttttgtctttcccactgatttctaaatccttctggttactctattgctacaataattttatgactcataggaggaatatttgtgtgaaagattaagatgctaattctttaaaaatgatattcatagactaccatatatagtcagcataagtgaaacagaataaatcttgcaacagtactcacagttttccaaaataaggttttcttttgatgttagtaaggtaaggaagtggtaaaactttctttaggttaaaatcttaatgaaaggtattaatttgagcagtctgaagtctaagtgtgctatttgtttttccttcggcaaaactttacagaaagctaatctttaataaataaacttagtaaactaactctaagccatttcattgagttaaaatctaaaggacttaagtggcactgaagaaagtctgaagagttgcatattagtaggctcactgagcttgtacttgaccttttcttctagaaagttcttacagctataacctgacaaacaggaaaatgattttttaagcagtttcatagttttaccttgagataatagtatttttcccttcttaaatcattcattctacaaatatcaaatgccctgctttatactatgccctgtgattgcagaatcaagctaagacagactttttttatattaccataaaaaatgttatggcaggaccaggcgtggtggctcacacttgtaatcccagcactttgggaggccgaggcaggtggatcacctgaggttaggagttcgagaccagcttggccaacatggtgaaaccccgtctctactaaaaatacaaaaagttacctgggtgtttggtgccgtttgcctgtaatcccagctgcttgggaggctgacacaggagaattgcttgaacctgggaggcagaagttgcagtgagctgagattgtgtcactgtaccccagcctgggtgacaagagcagaacttcttctcaaaaaaaaataaaagaaaaagttgtggcagatgtatgcactgagtgctgagaaagtagagagagaggaacacatgagtcagtagtggaaaggaagaacagtgaagaattttttttttttttttttttttttttttggacacagggtgttgctccaccacccaggctggagtgcagtggcacgatcacagctcattgcagcttcaacttcacgggctcaagtgattctcatgcctcagcctcccaagtagctgggactacaggcatacggcaccatgcacagcgtttttttttttttttttttggtagagacaaaaggtgggcatggtagtgtatgcctatagtcccagctttttggcagcttttctggggattacatgtgtgagccaccacactctgccaagacttctttagggaggttcattgatttctttatccaaatattgaatacaaactatgtgccaggcatggttctaagttatgagaacggatatacaatgagtcagatattaaaagtggaagaaagaaaaatagaccagttatggtcagagtgataggctggggatggagggagatgatagcttagattaccttctccagtgcaggtctctgtaattgacgtcttttgagcagagatctgaatgaactgagagtgagagccatgtgaatatctggggaagggagagaatgcttcatgcataacacaacagcccgttcagaggccctgagacatgtttggggaacagcaaaaaggccactgcagcatgaacagagtctgtgaaaggcagaatggggctgcattacagtggtgcttgtaggttttgaacagaggagtgacatggtatcagtaactttttaaaaaatagggagattacttggagggcagttgcagtaacccagggagaggatgaccaaagtggtggtgatgaaagtgattgggttgaggacttgagtactagtggacgagtgggaagttaagttagaagaaaagggaagataaaagtagctagtagatgggcaattactaagccctggaacctctaataccatattgctagtggtaagatgatgagcaatgagactgaagaccacctcagaatggctttgtgtcataagctaagaagtttgagccttgtcctgaaaatgttgggataccattaaaaatcttctttaggggtcttctgctatggttttccctatttttattatctgatcatttgaattttgaaatccaaatatctcattttcttatatttaaagctacttccttaggtatagtatacatgaatttttaatgtttaatatatcattggaccaaaatggtagaactattctaagaaagagtagggaactgacatttaagcacctactgggagccatgacctgtgtcaaacacgtgttttaattctctcaatgatctattgagtgttcatctctgttttatagataaagaaagtgagcatcaagcaggtaaaggaatttgcccaaggttagaaggctaataaatattggatcgatccaagatttgagcccaggtctgtctgaatctaaaccctttatagtctctaaactatactgtctttctggagttgaatatgaaactaaagtcatatgaattttatttataatgtatcaaagattttttaatcaagtaagccactgaatagtacttttgctatattgttaaagtttgagttaatggtacctctagaaaaggttgaatcatacaagcggtccttgttagtctttggtattctagagtagtgcttcttaatttgtaatgtgtcaaggaattacctcgggatttgttcaaatgcagttcttattcagtgggtctgatttagtaggattgggacctgagattctgcatttctaacaattttctggtgatgctgatactgctggttaaaggagtgcacaaatagaatactgttgaatggcttaaacttaaatccatagaaatatccttagagatcattttagcattcctattttaggctggaatgaaacctttactgagtacctaaatacaaatgagtggttccatcatttcatgagctcttatttaatataaaaaccctgcaaaatatatgttacctactttttcttaaatctattatttacaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaatctattatttgtaagggcacaaaacaagtctctgagagatggcaacttcacaaagaccgatcatacttttccacagataggctcttaatcatgtcagctcagcaaactttggttgtatttggtggcagtgctaagtcctaggg

SEQ ID NO: 476 - DNA, 3698 bp, Homo sapiens
gatacaaagacaaaaaagtcagcgtctctacttcttgagtctgttgagaagagaaggatgcaggcaaatgattggggtacagggaggcatctgctataaagaggacatgaacatagtagttggggcaccagtatgctggtgcatagaatgcaggtaagtagtagtgccagaattccaatctaagccttcatatgtatggtccacagtttcatcttattctaccacactgcccattgtaatccagaaggggcttggattcatcagcgtgttctagtagtttggcagaagaatcttctaagtacctataggacatgggtgaacctgaactcaggatggggtgggcaggatggattagccaccaaccactctttgtttgcccaaagcttattttcatcagtatgtttatagtatcattagtttgggaggccaaggcgggcagatcacctgaggtcaggagtttgagaccagcctgaccaacatggtgaaaccccgtctctactaaaaatacaaaaattagccgggcatggtggtacacccctgtaatcccagctactcgggaggctgaggtgggagaattgcttgaacctgggaggtggaggctgcagtgagccaagatcgcgccactgcactccagcctgggtgacagagcgagacctcgtctcaaaaaaaaacttatttcttttaccaaaacttgatgtatagactgccttttcttcagtaaatgtttattttcccatattcggcttatcaaagccacaaaataagttagtgataataatatagtcatgtattgcttaatgactgggataagttctgagaaatgggttgctgggtgatttcataattgtataaatatcatagagtaggcttacacaaacctagatggtatagcctattatacacatagactcaatgatacagcttatcgctcttaggctacaaacctggacagcatgttaccgtactgaagactgtaggcagttgtaacacaatggtaagtatatgtgtatctaaatatatctaaacatagaagaggtaatgcattgcactataacattaccttatgacagccacgacatctctaggtgacaggaattttttagctctattataagtttctgggatcaccattctatatgtgatccatcattgactgaaatgtcattatgcagcaaatttgtatataactatttccattgcgtctgcctaaaaatcttagtagtgtgggcagaacttgattagggattgtttaaggcatatatggtcaagcatatgaatttcagatatttatgtttatggaagactcctttgtaaaaaaaaactgaagaagaatcagaggtgatacattttagttcctgtttattttgaaagccaaaagtctgcacaaattgcagaccaaagtatcacaaactactaacaaggcagtggtttctaataaatgttgctatctttgtcctgagcaaccttgcaaaactgtacattcccactcataaaaaatggagaactttttccctatagtctagggcagagtgataagtttttctcataattccacatagcttatagttaaactcagtgtagaagagtgatgaacacaaaacaatacatactgtattcaagaaatcagaacaggtgcaatttaaatttataggtggggaagagtcttactagtgggacagattggagaaaagcttcacaaagatatggcataagaatagagtagaattgggtcaggcacggtggctcacgcctgtaatcccagcactttgggaggcaatgtgggtggatcttgaggtcaggagtttgagaccagcctggccaacatggtgaaacctcatctctactaaaaataacaaaagttagccgggtgtggtggtgcacccctgtaatcccagctactcaggaggctgaggcaggagaatcacttgaacccaggaggcggaggttgcagtgagctgagatcacaccattgcactccaggctgggcaacagagtaagactccgtctcaaaaaaaaaaaaaaaaaaaaaaaaaaaaaaagagtagaatttcagtgggttgaaaacaatggaggctgggaggacacaggctttggggtggacatactgagaatgtagggaggtggaaagtgcatgacacttctgggtactggaaagacaggagtgaacaagccatgcggctgggaggactgaatgaattactaaagtgatagaatcatcttaccagagagaaagcagctgatgaagtaggagaagaaactatatgtagacaagttattaggaagaagtgacattcagagtgggaagggatgagagggagttagctaagcaaagaaggtagagagaagagttcctgcagggagcaactgcagttgtgaaggtcctggagctgggagaggagatgtttgaggaactgagagaagattgaatgaggagggatgtgaaatgatgtggaggaatagatagagcctggcatgttggatgctttcagtaccgaagcagtgctatataatgcctgactatagaggataacccactaaaaatttgagaattttcctttagggagctgagccttgagtcagaggacttcctccttagaggaggtgaggtaagatgatcatgtggctgtggtacatacaaagtttaatgttggagttgaataagaccaatttggaagttactgctaaaactttgtcatggaaatgtgaaagtttatgtgaaagtttcaaggtcaaaagatcgagaccagcctggccaacacagtgaaaccccatctttactaaatacaaaaattagctgggcgtggtggtgagggcctgtaatcccagctactcaggaggctgaggcaggagaatcgcttgaacccagcaggtggaggttgcagtgaaccaagattgcgccatggcactctagcctggcgacagagtgagactcggtctcaaaaaaaaaaaaaaaaaaaagtttatgtgaaagttttgagggacaaatggaaatggcattttgaagaaaccccactcaaaatatgggaacatatcttgtgaagtgtcaaatgtccagttggaggagaaagactagtattgaccctgtgagaggcattaaagatatgggagtcatttatgtgaatatggcaagccatgggatttcatgaaagttccaagaaaagaggattaaaaaaatatgattactgtttgtcataattgtggtgtagtattcaagagcatgatttctggagagctcaactgtcaaggtttgaatctcactctgccacttactaggttgggctgaatgatcctggacaagctaacttttctttgccttagattcctcatctgtaaagtgggtataataatagtacctccatcgtagggttgttaagtgacttaacatttgcttgcaaagaacttaggaaaagtgccgtgtacatagtaagaacagtttgtgaatcatcataaatacacgagaccagaatttcaaaacaagcagcaggcagaatgttcctttaaaaggtcattgaatgtacttttccagctactcttgttactttctaaggaaactacttgataatcctgtactttgtaggactcatcagggtgtgtttagtaaacttcagtgtcctaggtgacttctttattcccaaattgtggggcaggtgacaaggggaggttggtcctctaactcgtggtgtagttaatcaggattt

SEQ ID NO: 477 - DNA, 17277 bp, Homo sapiens
gagaaagggttcctaagagactacatttgagatcaaccttgatggacagatgagatttttgtcacctgagattctctacttcaccattacaccattatccctatagagatagagttttatttttaaattttattttattttatttttgacacagggtcttgctgtcacctaggctggagtgcagtggtggcaatcatagctcactgcaacctcaaatgtctgggctcaagtgagcctcctatctcaacctcctgagtgagctgggactacagatgcatgccaccatgcctgactaatttttttttcttcttttttgtacagacaaggtatcactgtgttggctgaccttgaacttctggcctcctggcctcaagtgatcctcccgccttggcctcccaaagggctgggtttaaaggtgtgagccaccacaccaagcccaggtttattattaagcaaaatattttaggaaatgtgtgctcagagatccctggcctccacccctggagactgactcagtagttctgggatagggcttgataatctctatttttaaaagcatctccagtgtttctgacattctgctaagtgagaattagtaatgaactaggaatccagtaatgaactaagaatccattttcgtttggcataaaactcagacaaatcacatcgctttcctgtgccttcccttatttatctttaaaaagggaattgggctagatgataattaaagtgagaggtcaaggttttcaaattccttgattatttacattattgggaaagttgaaactacttgtacacaactcataacgtccaacagtaggcggagagatatccttcttagagtaatagagaagtagaatgtacaattgaaacactggttgcctaaagcaggggagataaaattatgaacggctggcttacacacattcacgagtgtgtgctcacactcaaaatgagtggaactagaatctcccgcactagatttttttttctccttctggttgatctggggaaggggggctggcgaggatgttggtaatgactatacaattcttgccaagggagggatacactggtataatgactataattttttctttcttccccagattgtaaccgcccagtgggttcaccttgcctgttgcctagagagagctgatttatcaaaacaggagaattgcaatagagaaagagcaattcacgcagacccagctgtgtgggagagtagagttttattattactcaaatcagtctccccaagcattcgggaggacaacttggtgggtggggagaagccagtgagccgtgagtgctagttgattaggtaagagatgaaatcatagggaattgaagctgtcctcttgcactgagtctgttccggggtgagggccacagatcagatgagccagttagtcactctgggtggtgccagctgatccatcaagtgcagggtctgcaaaatatctcaagcactgatcataggagcagcttagaaagggtcagaatcttgtagcctccagctgcatgactcctaaaccataatttcttatcttgtggccgatgttagtagtccagtccccaggcaaggaggcttcttttggggaaagggctgttagcaattttgttttatttttattttttgagacaaagtcgcattctgtcacccaggctggagtgcaatggtgagatcttggctcactgcaacctctgcgcctcttgggttcaagcgattctcctgcctcagcctcccaagtagctgggattataggcacccaccaccatgccctgctaattttagtattttagtagagacaggatttcaccatgttggccaggctggtcttgaaatcccaacctcagttgatctgcccgcctttgcctgctgaagtgctgggattacaggtgtgagccaccatgcccagcctcatctttgttttaaactatagcctataaactaagttcctcccaaagttagttcagcctatgcccaggaataaacaaagacagcttggaggttagaagcaagatagagttggttaggttagagttctttcattgtctcagttataattttgcaaaggtggtttcaaaatcacctcaaaaaaaaacttttttttgttttgaaatggagtcttgctctgtggcccaggctggagtacagtggcaccatctcagctcactgcaaactccgcctcccaggttcacgccattctcctgcctcagcctcccaagtagctgcggctacaggcacctgccaccacgcccagctaatttttttgtattattagtagagacaaggtttcactgtgttagccaggatggtctcaatctcctgacctcgtgatccacctgcctcggcctcccaaagtgctgggattacaggtgtgagccaccacgcctggccaaaaaaaattttttttctctccactacctaatgcagtggtcctaggaccagggctgtaactacaagtgctgcaagcaggaattatttctaagcaggaaactgtcactatgtttttaaactttgtcagaattcctaagggaccgatgaggggttggttgtgccttcaccccatctggaaaaattgggattaagaataaatacaggctgggtgcggtggttcaggcctgtaatcccagtactttgggaggctgaggtgggtggatcacctgaggtcaggagttcgagaccagcctggccaacatgataaaaccccgtctctactaaaaaaaatacaaaaattaaccaggcacggtggtgtgtgcctgtagtcccagctactcaggaggctgaggcaggagaatcgcttgaacctgggaggcagaggttgcagtgagctgagatcacaccattgcactccagcctgggtgacagagcgagcaagactctgtctaaaaaaaaaaaaaaaaaaggctcactagttcagatcctatgtgacccttccttctatgaatgggcgtggactgagggggaggcactcgctagacaggtattgctaccagcgacatgaatcagcacagtggccaaacctaatgtcccttccaaaagtggaaaaattggggtaaaattaaatgacaaatggaaaaaaggaggaatagccaagaataaataaatgaaaaagtgcgttataaattgaggaaaatccaatatcatattaatgactctaaagagactcagagcaaaagatgacactgtctcttaactcgatgatcccagatgcctgaaagggcgaagcagtgtgcctgccgagaccactcctgcttttggagtctgacaagattaaaaggaagcttgcaaacttgagtggcctctgcctgggagacagtcacacaatatgatggactaaagtaattattaaagattctgtatatttgttttgctgtaagggatccatggttgaaaaccagaggtggcctatggtgtcatgatatatattagtttgcatacagttcctggttcctaactcccatagcctcattacagtcttttgttatgttgggttaggcctcaggaaacagaattttctcctgccctcctttcacctgccccgagccaggacttgcccgcttttctgattgtgggtcttcagaccctccccagagtgagtcccgccctataccctgggggaaggaatgctgaatcaggaaacttccataaaaacacaagagggccaggcgcagtggctcacacctataatcccagcactttgggaggccaaggcggacagttcactggagtgcaggagtttgagaccagcctggctaacatggtgaaaaccaaaaataccaaaaaaaaaaaaaaaaaaaaagttgggcatggtggttcacgcctgaggctgaggcacaagaattccttgaacccaggaggcagaggttgcagtgagctgagatcgtgccactgcactccagcctgggtgacagagccagacttccctcaacaaaacaaatccaagagaagtgagtttggggagcttctggatagctgaagccatgaaggttcctggaaagtggtgtgcccagggagagcatggaagccccttgccccttcccccatgctttgccctacacatctcttcatctgtatcctttaaaatacttagacacgataaacattcaatatctgtttagtgaggagggacacaaatcatattagttgtaaggggtgacttcaggtttctcttagaacactcagactcaagtgagtaactcaattatgttaaaacattaaccttcacttgtggtgtattttctagtataatacatacatcaaaaattattctctaaaaatgtttaattttatgttttgaatatataaacaaagcatatctctaaaagttaacagagatggccgggcatggtgactcacacctgtaatcccagcactttgggaggccgaggtgggcagatcacgaggtcacgagtttgagcccagcctgaccaatatggcgaaaccccgtctctactaaaaataaaaaacttagccagacgtggtggcgcatccctgtagtctcagcttcttgggagcctgagacaggagaatcgtttgaacccgggaggcagaggttgcagtgagccaagatcaggacactgcatctctcaaaaaacaaaaaaagtcaacacagataagttgagatttggatggtttcctagggttcaaaaaatgctatctcctttttctttttctttttttttttttttttgagacagggtctgttgcccaggctggagtgcagtggcatgatctcggctcactggggcctggacctcccaggctcaagtgatcctccagcttcggcctccagagcagatgggactacaggtgcatgccaccacacccagctaatttttgtgttttttagagacagggtttcagcatgttaacccagctggtctccaactcgtagcctcaagtaatctgcctgcctcagtttcccaaagtgctgagaaacaggactagctggatttccttggctaagaattcctaagcctagctggggaaggtgacctcacccacctttaaacacagggctagtaactcagctcacacccaatcaggtagtaaaaagggctcactaaaatacaaattaggctaaaagtaggcagtaaagaaatagtcaaatcatatatcgcctgagagcatggggaggggacaatgatcgggatataaacccaggcattcgaaccggatcgggcaaccccctttgggtcccctcccattgtatgggagctctgttttcactctattaaatcttgcagctacacttcttgtccgtgtttgttacggctccagccgagccgtccaccactgctgtttgctgccgttgcagacccaccattgacttccacccctccggatctggcagagtgtccactgtgctcctgatccagcgaggcgcccattgctgctcctgatcaggctaaaggctcgccattgtttctgcatgactaagtgcccaggttcatcctaatcgaactgaacactagttgctggtttccacggttctcttccgtgacccacggcttctaatagagcttaacactcaccacatggcccaaggttccattccttggaatccactgaggccaagaaccccaggtcagagaacaaaaggcttgctgccatcttgggtgtggcctgccccatcttgggagcggcccaccaccatcttgggagctctaagaacaaagacctgcacgtaacagtgctgggattacaggcttgagccagtgcacccggcctacttcctttttctaaagtccatcctggtgtatatgtatcctaaacacccaaatatgtaaccaaagactttgtgaatgaccctgctcaccaaacagcaaccttgcaggatcagcaactgcagttctgactgcggctgtcgctggtgtaaataaaatgaaacaatgagcaaaatagcacaaatttaaaactaaaccatcagtgtgctaatcaaactgaaagtcttcctaaaagagccaaacattttaacataacctttcccactctcatagttgttaatgttagggagcaaaaaccaaacatcgattgaaaaggcagttttaattggttgcagaaaatgaaaggttacttcactcaaaaaagtaaaaaaaaactcattgtggtaattcagaattggaaaatgtttattcctgcaaatgatcggtaagcttgctctgaattccctggaatcccagcatagtccccaaatagacaggcttgcctcaccccacagaggatacgactctgaaaaattgaatatgaagaaatactgaatatgtcaagtcattcaaaatccacaaggaggccaggcgtggtggctcatgcctgtaatcccagcactttgggaggctgaggtgggtggatcacttgaggtcagttcgagaccagcctggccaacatggtgataccctactaaaaatacaaaaattagctgggcatggtggtgcatacctgtagtccaggtaggagaattgctgaacccaggaggcagaggttgcagtgagctgagatggcaccactgcactccagcctgggcgacaggacaagactcaaacaaaaaaaaaagaagaaaaaaaaatccacaagggttttgaaggacggctttactggaaaaaaaatccacaaggggaaatggttaatcaaagaaaccacacagttgatgtatttccatgaattcaaagccttttaatgatgtgaacacttactccccatttcttttttacattgttacaaaaaatttacatacagttttctgaaagtggcattttgttggttgttattatactgatgacacatattaacactttgtattgaagaagtatcataaaaatcacagggcattacagatttttgataagaagtagtaatagcattgtcttttaacagctggaggctcccaggcatactctttggtgagaaatgattaattttatattttcattttgatgagaatcttttcttgtttttaccagttataaaaacaaagctttttctttgttgtgatactgtgcactaagacttagtttcttgagctgatgctaaataaaatgagatcaataggaatattccaggaggtcgtgagaagtttttagaaaggatggcatctacatatatatggagctctgaaaactgttggagagtatgacctgggactgaaactgtggagcacatagccagtgtcacaggctccgagagcagagagagtttgctctgggacctggaatgagtgatggagaaatgttttaaacaaacaaacaaacaggccaggcacagtggttcacatctgtaatcctagcactttcggaggccgaggtgggcagatcgctttagctcaggaatttgagattagcctgggcaacatggcgaaaccccatctctctacaaaaacaaacaaaacaggcctggcacggtggctcaagcctgtaatcccagcactttgggaggtcggggcaggcagatcacttgaggtcgggaggtcaagaccagcctgggcaacatggtgaaaccccatgtctactaaaaatacaaaacttagctgggcgtggggccacatgcttttgtaatcccagctactaacacttgaatccaggaggcagaggttacagtaagctgagcttgcaccactgcactctagactctgcatctcaaacaaacaaaaaaacaattgtgggaaggttcctaggtttactgcactccagtttaatgcttgtatagtactcacacttatatctcaagacttttcaagggctgacccacccgttttctgccacatgcagtcagccccaaggcctcatctgtacccaaaggcctgtggacaataactgcctcagcaaaaaaaaaaaaaaaaaaaaaccttgaagcatctgacagaggaaacgtactccagagccaccgtgagctgcccctgttcctgaccaccaagcccagcctggacagcctgctttcccgccctggcctgaggctggctcagtcctggatctctccccagtcctgctttcccactggtgcctctaagaccccagtgtggagtctgcacctcatctcctcaacacgaacagatattggtcctcaaacacagaaacacactcttagcttggtttctgctctattttggtatttctacttttgaactttgttcagtgttcctttctaaaacctaaccactggatccaacccagggttgtagagtgtccattctgagtctgctatttccccaagtgtcccctcagcaggcagcaggctctgctttatcctggtgggggatgggtgcgccatcttctccagctacaagacagcagagtgggtctcctggaggttctcctccagcttcagccccaggttgtcaatcccaatgctggtgactggaggcacgctgctttcagccggctcggccgtgcgagtaggggtggagcagtacaggataaaccccaccatgatgacagtgaaggacaggatgtagagtcctgaaaactagaagggaagaacaggcagtgaattgtgcccctcacatacacatctttgctgctggcttttgccaactgtgcttcgaggattaccctctcataatctttttattttctttctttctttctttctttctttttaagacagggtctcgctctgtggcccaggctggagtgcagtggcacaatctcggctcactgcaacctccacctcccaggctccagtgatcctcccgcctcaacctccagagtagctgacaccacaggcactcaccaccacacccggccaatttttgtgttttctgtagagacggggtttttccatgttgcccaggatggtctcgaacacctgagctcaagcaatccgcccgcctcaggctcccaaagtgcgggggattacaggcgtgggccgccatgcctggcctcatgatcttttttctgaaagttacctaaggagatgctaatgcacaaaaccttcccatgtatgctggtgaatgatgggactctgccaacagcacccggcacataagccacctggatccttggatctttaggagaaatggacctttgcttttctctgtcataatccagctacaccccactctgcatatagtcccacttagtggagaaaataaaaggtcatcatggataccacagagagccccattcagaccctagacactgcttacaatattggtatgaagcagaggaacgtaagactatgatgaaatgtggaagtacagaaggggcatctgctcaacagcctctcaatgtgtgctattcaatgaaattcattttgctaaaatttaatacattatcttgtctctgtgggcaagtattacatagtaaaatttatggtggactgagcagattcagaattgtagagctagaaagagcctaagatactagaagagtccaaagcccaaagaggtgactgagtgtaaggtccggtgaggacaatcataggaaacagagccctgtgagaggcatctcatacactctctgttcccagaaggaccaaaaagagcaggagcccattctgacagaaattttaaaagtatggatggagtttttggtgaccttccccaactttccccttcctaagactgaaaaccaccacccagagcaaaatgcaatgaggaaagaacactaattcattgggtatatatatggaaaaatgatataccccaaaagtctaaataaattctattaagaattttgtatatttcctcttgagttgaaaatccatacaaaagttgaagtattaaagaaatcagtctgtattttttcttttttttttttttttagacagagttttgctctgtctcccaggctggagtgcaatggcgcaatcttggctcactgcaacctctgcctcccgggttcaagcgattcttctgcctcagcctcccgagtagctgggactacaagcatgcaccaccatgcctggctaatttttgtatatttggtagagacggggtttcaccatgttggccaggctggtctcgaacaccagaccttgtgatccgctcgccttggcctcccaaagtgctgggattacaggcgtgagctaccacgcctggccatcagtatgtatgtttagcagcatgataaagcacagaaagagagtggctaaagactgaccaagaatggtgtactaaaaattagagaaactatgtactgtaactaatgtgtaatcaaatacccagggccttatttttcctttcaactggaaaagcaaactcaacttatgattaatcctgctaacctgattttaaaattaggaatggagtagctaacatcatactgaatggggaaaatataaaagccttacttttaagaactggaaaaaaacaaggatgcccactttcaccactcctattcaacatagtactggaagtcctagccagagcaattaggcaagaaaaagaaataagaggcatccaaattagaaaagaagaagttaaattatccctctctgtagatgacatgatcttatatccagaaaaacctaaagatgccacaaaatagctcttagatctgatcaataaattaggtaaagttgtaggatacaaaatcaacatataaaaatcagtagcctttctatacactaataatgaactagctgagatagaaaccaagaaggcaatcccatttacaacagctacacaaaataaaataggactaaatttaaccaaggaggtgaaagacctctataaggaaagctacaaaaccctgatgaaagaaattgaagatgacacaaatggaaacacccatgcttatggactggaaggattaatctcattaaaatgagcatactgcccaaagcaatctataaattcagtgcaatccctatcaaaatatcaatgttatttttcacataaacagaaaacacaatcctaaaattcatatggaaccacaaaagggcccaaatagccaaagcaatgctgggcaaccaaaacagcatggtattagtataaaatgaaaatgaactcctatctctcaccatataaaaaaatcaactcaaggtgggattaaagacttaaatataagacccaaaactataaagctactagaagaaaacacagggaaacactttaggacattggtctagacaaagattttatggctaacatctcaaaagcacaggtaacaaaaacaaaaatagacaaatgggactatattaaactaaaaagtttctgcacagcaaagaagacaatcaacagagtgaaaagataacctcctgaatgggagaaaatatctgcaaactattaatccaacaagggactaataaccagagtatacaagtaactcaaatgactaaagagtgaaaaacaaataatcctattaaaaagtgggcgaaggacatgaataaacattcaccaaaagaagacataaatggccaacaggtatatgaaaaaatgttcaacatcactaatcatcaggaaagtgcaaatcaaagccacaataagatatcatcttacctcagttagaatggctattattaaaaagtcaaaaaataacatgctggcaaggatgtatagaaaaggaactcttaggccaggtgcggtggcccacgcctgtaatcctagcactttgggaggctgaggcgggtggatcacctgaggtcaagagttcgagaccagcctggccaagatggtgaaacctcatctctactaaaaatacaaaaactagctgggtgtggtggtggcacctatccagctactcgggaggctgaggcaggagaatcacttgaacccaggaggcggaggttgcagtgagccgagatcatgccactgcactccagcctgggcaacagagcaaaaactccatctcaagaaaagaaaaagaaaagggaactcttaaatactgctggtgggaatgtaaattagtatagtagagccactatggaaaacagtacggagattctcaaaaaactaaaaatagaactactatacaatccagcaatcccactactgggtatttatccaaaggaaaagaaatcagtatatcaaagggagatacctgcactcatctgtttattgcagcactattcacaatagcaaagatatggaatcaacctaactgtccgtcagtggacaaatgaataacgaaaatatgatatataaacacaatgggatactattcagccacaaaaaaatgaaatcctattatttgcagcaacatggatggaactagaggtcattatgttaaatgaaataagctagggcacagaaagacaaatagtgcatgtttcactcatatgtgagagcttaaaaagtcaatcttgtggaggtagagcatagaatgacagatatcagaggctgtggaggatgtgtggattgggggtgggagataaagagaggttaggtttttgtagtggtggttgttttgagacagggtctggctctgtcacccaggctggagtgcagtagttcaatttcagctcactgcaacctgtgcctcccaggctcaagcaatcctcccacctcagcctcccaattagctgggactacaggtgtgcaccaacatacccgtataatttttgtattttttttttgtagagacagggttgtgccatgttgcccaggctggtctcaaactcttgagctcaagcaatctgtgtgtcttggcctcccaaagtggtgggattacaggcgtgagccaccatgcccagcctaagggacgttgtttaatgggtacaaacatttagttagatagaaggaataagttctaatgtttgacagcagagtaggttgactacagttgaaatgataaatactcgaggtgatggacgtctcaaatactctgacttgtacacagtctatgcatgtaacaaaatgtcttatgtatcccataaatatgtataaatatttgtatcaataaaaaattaagaacggggcattctattttattcacaccaataaatagttttaaattagcttaagtttcatattatgcccaataaaaagttcaaataaggagatgacagcaaaaaacagtaagaaaacagaatgggctagggaaggagggaaaaggaagagaaagaagatgagaaggaaggagggggtggaaggagtgagacagagagagaagaaaaagcaagcaagctagcttggcacagtggtaggcacctgcagtcccagctactcaggaggctaaggtgggaggatcacttgagcccaggagtttgaggccaacctgggcaacatagtgagaccctatcgctaaaaagaaaattaaaaattaaaaaaaagcaagatacactcccaaaggtaaaagaaaaaactaagtaattttttgaaatgagtattaagtagattgctggtcacatccagctgtgggctccttgggtcaccaacagctttaatgtgctaacttgttatagatgctcaattatttcttaacgttaaaccttaagaattccttaaggaatgtaatagccacagccctccccaagacaggaaaatgcttcctggattaaatgataatgcaaaaccaataataatgtcaagctaagcagacaactataatttcctaccactgattttcattcttggatctaatacatagcacagggcccaacacatagctggtgtttaataaatgtttgttgaaaaaaattgattcagagaatattaggggaagttagagctgtttggagtactctaaactttttaagttggtattttttatttttttttgttatttttatttatttattttttgagacagagtcttgctctatcacccaggctggagtgcagtggtgcagtctcagctcagtgcaacctctacctcctgggctcaagcaattcttgtgcctcggcctcccaagtaactgggattacaggtgcccgccatcatgcccagctagtttttgtatttttaatagagatggggtttcaccatgttggccgggctcgtctcaaactcctgaactaaagtgacccactcacctcagtctcccaaagtgctgggattacaggtgtgagccacttgcgcccagccttaagttggtattttgaaaggtaatcttgctgtcccataaaatgtttactgttacctgtgaaaacacctatataacttgttcaaaacctgttatatttggtttggtggcttttaaatgttcagaagaaaaactatcatgtctctcttaagaaggcaggtgattaaatggagtcacttttattaggatggagagactaataaagagattaagtctcctgaattagaggcgcttacttctttgtcttgtaaaattctttgtgtctggatctatacaggaagtttcttgcgattactttattcagcaaatattcactcaagatcaatttcaggagaggcagagtgcttaagggacacggatgagcgtaaaaaattctgagcctctttttcaactgtctgcttcaaaaaattagagccaaagttattttagacacagtttttaaaactggtagtgtatcaagcttacaatctgcctttaaaaactacttcttggccaggctcagtggctcatgccctgtggtcccagcactttgggaggcagaggcaagcggatcacctgaggtcaggagttcgagaccagcctggccaacatagtgaaaccccgtctctactaaaaatacacaaattagccgggtttggtggcaggtgcctgtaatcccagctactcaggaggctgaagcacaagaattgcttgaacccagactgcaggggtggcagtgagctgagatcacaccactgcactccagcctgggtgacagagcgagactctgtcgcaaacaaaacaaactacttctaaagtgctaggtgtcttcattatgctctgagttttttctacctctgtaatttattctgaagatttcagaagacctgctctttgctctgtaagtcttgaaacatttgaccaaaaatagtaaaaatctgatctaagaatgtactattagacattcagggacaaaggaacacaaaataactggaaaggaatttatcaactgcatgctctgattctgagaatagtagtttaaagttatgtggccaaaaaatgacataagaaagggatttttcattttaaagttgaaagcagttgaagccaaagccggccaccaactggcctgcaactgctatatagaaacaccagcacccctagtggtggccagatgaaatgcagccacggcatcacagaaaaacttaaggctgacattgtagtctatgacaatttggctctcagaaaaaaatctgcacccatcaggatgacttctctgattcactttgactttatttatttattttactttttttgtttgtttgtttagacggagtctcaccctgtcacccaggctggagtgcaatggcatgatctcggctcactgcaacctccacctcccgggttcaagtaattctcctgctgggactacagatgcacgccaccactccaagctaatttttgtacttgtaaagacggggtttcaccatgttggccaggatggtctcgatctcttgacctcgtgatctgcccgccttggcctcccaaagtgcaggcgtgagcccctgtgcccggcacactttggctttttttttgtttttgtttgtttttgtttttttttttttgagacagagtcttgctctgttgcccaggctggagtgcagtggcgtgatctcggcttattgcaagctctgcctcccaggttcatgccattctcctgcctcagcctcctgagcagctgggattacaggcgtatgccaccatgcccggctaattttttgtatttttagtagagacagggtttcaccgtgttagccaggatggtctcgatctcctgacctcgtgatccgcccgcctcggcctcccaaggtcctgggattacaggtatgagccactgcgcccggcctggcttttttttaatgatgttactagtaagctataaatactccttcagtcttagttcaggaataccttaaccagcaagtctgcaaagataacagctggttccttcacatgtaaccttgcaaaccaaaggtttacactccttaagcagaaatttctgagaatccactgagcttaatgtatcagtaattcagctaagtgttgtgagttcatggccgacttctgggaatagcataaataaggatttgtctggatacaaaattctacaaggacgaagaaagatagttaataacctctactgaaactaaaattatcaggtaacagccagcattctaactatctgctcaaatgactgtcaagaaaataggaagcaggtcaacaatcctttactgaaggcacactgagaaaagacaggtctcgctctgtcagccaggctggagtgcagtggtgtgatcagatcatggctcactgcagcctcgacctccctggccccaagtgatcctcccacttcagtctctctctggagtggctgggactacaggtgcacattaccatatctggctcattatttttgtatttttttgtagggatggggttttaccatgttgtccaggctgaaaagaggtatttctaaagcaggggttctcaaagtataatccaaaatccttgaggggacctaaaactctggggaagaatctatacagtgaaagctattactacttttttttttttttttttttttgagacggagttgctcgttacccaggctaaaatgcaatggcacaatcttggttcactacaacctctgcctctcaggttcaagcgattctcctgcctcggcttcccgagtagctgggattacaggcatgtgccaccacaccctgctaatttttgtatttttagtggagaggggggtttccccatgttggccatggctggtctcgaacccttgacttcaggtgatccaccctcctcagcttcccaaagtgctgggattacaagtgtaagccattgcacctggccctcaaaactatcattactataatactaaaatgctatttgcccatttcgctttcatcgtcttgcaagtgcacaatgaaatgttctagaagctacatgatatgtgatatcacaaggcagaaggaagaagcagatgtgagaatccaggtgttttttctagtaagccacagagtaaagagattttttaaatataaatcaatgaaattcttctcactatttttttattttgaaaaatacattttttcataaaaatgataacatgatgaatttattattttcttaatgagttaataagtattttttaatttctcagttttcagttataatatggtaaataataggtataaatgactggggttcccaatttttaagcatttaaaaggggcttaaaattttaaaaagagtga

SEQ ID NO: 478 - DNA, 6669 bp, Homo sapiens
aatccctggatttttttttctcatggtgtctcttgtcactctaaaatggacctaaactaagaggtagaataacaataatgaaacaacaacaacaaaatactgcttttgtagtgctacccatcttgtttgtacagtgtttgatagctttccactgcattttccttgcatttcatcaacctcactagttgctgtggtataccgatcacaacaaaaatgatgagcatctcagccctgggcatgcatgattcagcataatgcttgcaatggccttatcagggggtagctgtcattgtcctcctttaccaatgaagacacaggcttagagagattgagtaatgtgtccaaggtcacccacctgacaagtgatggagatgagatttgatccgaggcttacccgatgccagggcctgaccaggtaaaatggtcattctttcggtgacagaattgaggcagaggacttgtgaggtcacccatagatgaagaacggatccaggcacagaactctggtcttgttaattctcacagctgctcttcttacctcaccaaggctaggagaaaagagcatctagtcaccaaacaaactcatgctacagagactctctagtctctttcataatgcaaaggaaaagaattctgaaattctataccaagctgttaggtgttttccttggattggggaatgtagagggattaatgaggacaggaggcagaccttatcagggtgaaataacatgaaaaaatgaggatgaactactctttcttcatctactacccaacctctcaaataaatttcttgcaaaattaagtgaattcttgcttcaaatactcaaatagaggatttatcttgtttgttccatcttgtgtgatgaatccaggtgttttctaaagcagaaggcacttaatgtaggttctttatttttttgtgctgattaccctaattggtgggtttccttccaggatcagcagccaattctccactagagtagtatcactggaccttagggtctatttacagtagcagatgtagtggtcacccaataaaaaagtcgctgggtgcggtggctgacaactgtaatcccggcactttgggaggccagggtgggcggatctcttgagcccaggagttcaagaccagcctgatcaacgtggtgaaatctcatctatactaaaaatacaaaatttgccagatgtggtgacacacgtctatagtcccagctactccagaggctgaggcaggagaatcacttgagcctgagaggtagaggttgcagtgagtcaagattatgccacggtactccagcctgggcaaaagagtgagactgtctcaaagaaaaacaaacaaaataaatcaaaatattgtttccacagtgcagttttagcctgctgtctcaaaagggcctgagatttgctatatagccaagctgtgtggactccacaggagactcaggattagcaccttagagtcttgactgggttttcttctttaaacgaagctgtagatttagctataatgccatttgtctgcgcttactactggatgggcacagtggattctgattcgtagtcctattcagtgaaaatagccaaatcattgtgaatacactttaatgtgaaatccttcttctgaagagcccagagcaaattcccatgttagggagaggcagatggatggaggcagagttagctctcaatgagttaaaggaatgtcagcatcttcttgactatactggtagctggtagaatagagtgtattccatattgtaaatatagaatacagtcaatctagacccaaagaaagagaaaggaggggcagcaggggatatactaacttatgaacttgagatttataagcattatcaatcttgaattgaaaaagtgaatctcttgagggagtactggtggcattccaaaagctaacccaagtatccatctagtttatagcaaatctaggcacataattcccttagatgatggaattgagatggaggacatggaaaatgatcagacacccttcctgcctggagtgtagctcagaatgaattatctgtggttaagggaggggtcaagggaggaaacggtggtactggtgaggcattccaagggcttggtgtgaggttgcagtaggaagtggattccagcttttgaaaaccactgttacatctacattgccagcagaaagctgaatgcctacatggcattggaatggagtgaggcagattgcaaaggatggggctggccttgaggttggatcatatgtggctgtttctttgactgtcaatcttcattcttaaatcttctcacttgaacaccttttattggcactaaatttgttttaggataatgaacgcagctgttccaattatggtgctcaccccactcacctccatgtttcacctctcaaagacactgcctctcccttgggactagccctgagcatggtgaggccggcatgcccagggctgaggctggcacttggagagccctagcgtcagaggggttaacacattatctgggcatactcaaatagtatgagcccatcaaataaacaaacacaccaacttgcaaatgaatagaaacatgtttattagagtagaggaaaaacagctttttggcacattaaccctgtggcatcaggagtggcagctgcagcctgggacgacaggcagggaggaggagacagtaaacgtgcattttgaaagtgcttaacatcaggagagggtatttccaagcaaagaggtgtgtgtgcgtgtgcatgtgtgtgtgagagagagagagagcgagagtgagagagagagacagagagagagagagagaaccatcaaagcagtacaaaggccaggaggcagtggtagtgtgcacataagacctaggaggatgtgggtttgaatcccgtctctttcaggaattgggtggccttgggccctgtgcctctctgagcttctgtctccacacagttctcttataatctgtccttggcaggcttgtaagtgaagatcatatgagatgacctgttttaagcatctagcacagaactcggcactcagaagctgctggataaatgccactcctcactgtagttctacgttagaatattccaagttttccatggttcctgaggaggaaggcagctgtgtgttcaggtagaaaagtatgaggtgtgggacagtgggaaattctcatgagcaggtttcaattgaggaataattcatttttgcagtaggcagattaattggaaatgataaactcctcccattgtaaaattaagaattaaaagtgtttatttttattcagtaaataccaaaccatgactgtagtatacttgtattccaaactttgatgatttaaaaagggaagagagaaggagggtgaagggaggagagagagagaatggctatgagaaagagagcaagactacattctgagttcctacacgtcatcccctatccccaaaatagcagctccacttgtatacattgataaattttcaatgtagcagttcattggcagagagatgtccaatacctaaaaatagcttgatagctcctagcatagatcatctgccatatcacctgatatttcatcttccccactaaaatgtaagctccctgaaggcagagattaataatgcatataggaggtaatctttgatatttaggatgaggcaatgaatacatgaatgaatacgtcaatgaatgaattaatcaatgaatggagagacaaggagaatcagactctcttggactcagggaatcttatatctttgaacactaaaattatgcttctgtcttttcttgctcttctcaacccaccttgcctgacagtttgttacattgtcaaactctgtcatttcttcatttagcctgcccctatttcactgttagccaaattcttacacccacagagatgatcctcaacctttgtatgttcaactcttgcacagtccacaaatcccccagtgcactccacggaaaccactttgcaaatgccaagcctagccttgtgtgtcgccttgatgaatgagtcaccaccagctgtgctgcccaccagacagcttcttggttccaggggcgccgcctgctttgtcgtatagcagtgttagtacgattgtttgaatacttcactgcattcttcccccacagaaaaatgaaagtgctgataccagtgataaaaaacataggtttcataaacttaacacaattgaggcaaagatggaaatcatttggcgtgcaaaaaagagcaaatgtttagcctcaatcgggtgcttatcatacttgagctatctgattgtgtgctcagctgtaaaggaaaagaaaaaagaaaagaaagagaacagacacaatgcagtaaatattgtcagagattaagtctaaaatatacggtgtattttggattttttttttttaggtttctagaaatgcagatataaatctagttcgttttcactctcaggcatgttttagcaatgtgatgtggtagtgcaaaaacttcttccctgattttcttgtcctactttgtcaaacagattcagctgtgtgtttatattttcaagaattgtagtaatgtcctttcagttgcctagtttttaagaaaacatctttgaaaataaatacttgcaatttttcctactcctcccaacatgagtgtccaccacgagtcccctttcgccaaacacttcatgttcctctgagctgtgctgccccttcctttcctctgtacttctgcatccttagtgttttctcttgaatcctgtcttctccttcatggtctctggaggggacactgcagatgcttaatttgtgaggggaatcacacaaacatagtagaccctaaagaaacatcttagttggattttgaagtgggcctagactccgcgtgtttttttctcaacatctttctttcccttactcaaaatatcctgcagctggggacttctctcactggcgctgttggttgttttttggtttgtttgtgcctcatcagcttcctctacctcattttgtgatcattttgacctaagaccattgcccagtggcttctcatttccaagatctctacttgggtcctttttcacaagtctgtgcttgtctcataactcctagccttgttcatgactgaaatatttttttatctctctgtggacatgaaacctacatatacagtcctattctcctttccctgttagctctgatccctctgatttgagttgttctgtctgttgagcctcttttattttgtttctttatttgatgttcatggtggcgttctttgtgaaatgtttggtgattctggattgaacccatctctgtaacgctgaatgaccatttgtctgcttgttgcctgtccttgcattctgatggaggaagtgggcgggaggtgctgctgctggaatgtgtgctggtttcggtaaaaatggggaaggcgtggaatgtgctatggggcagtgctctggtcctggctgtggtgagtccttgatcctcccaatgtcacctgccttgagaactctgccctgcgaagcggattaagtctccttcctagccttaagccatgcactccatgtctttctgtttggtgtagagatttagcctttctgacttctcccactgcaatgagatgactaatgctgtgttgcttccaaccatctcgagactttcatccccctcttgacatgggcacttgccatggttggttctctctgcttgctatctttcagggattattcaagttcctattcttagtatgtttctcttcccttattttgtgtgggtttggctggggcagggagttcagaaaggaagagaagattttatttagcaagccacctaaaacaggaagttgccttcttcgctgagtctgagacatactgacttccagaacatcacgaaaccaataggatcacagcccagggcctgaatcctcttgtttgaaccttgttgtagatgcacaacctgtgcatttcaaacgtaggaagcagggtgcacagtgggtacttgctctatattgaatgaaattaagccaatgtttcccacaatgtgtgtgatagatattgtgaaaatgtgaagtagaggaggagtgagagggaattcagtgtgctggtggtatcaagcgtgcaaactctgtttaagaactcctttcacaaaagttttaagattatcctttctagcttaaaaaaccaatatagacagaaaagaaaccccactctggtgctttctcccttcttccattcctgccttgaccatcccttcttcctcatagcctagaagcagcctctgggcctccaccttcccttttggttgtcccctcaccctagtctaacacttgcctctttgtagagaggagcttgtcggacacatgggattcacgggccaggtggttcagcagcccaacaacctggatcctcctcaccctcctctcctcatggccagcccagctcagggccgcctctgagagtctggcctccacaaaggaagatgaaatgtagagacgcatttgctgcctccaagtaacagtgcttcaggtgtttacctttcctcaagtcatagaactagagagcagggcgaggccttagggactgtctgttgaccgattgacacattctttgtattttgaaatgaagaaactgaccctaaacccgtcaagtgactttcccagtaagtgtgtggtaccggctga

SEQ ID NO: 479 - DNA, 8407 bp, Homo sapiens
aatccctggatttttttttctcatggtgtctcttgtcactctaaaatggacctaaactaagaggtagaataacaataatgaaacaacaacaacaaaatactgcttttgtagtgctacccatcttgtttgtacagtgtttgatagctttccactgcattttccttgcatttcatcaacctcactagttgctgtggtataccgatcacaacaaaaatgatgagcatctcagccctgggcatgcatgattcagcataatgcttgcaatggccttatcagggggtagctgtcattgtcctcctttaccaatgaagacacaggcttagagagattgagtaatgtgtccaaggtcacccacctgacaagtgatggagatgagatttgatccgaggcttacccgatgccagggcctgaccaggtaaaatggtcattctttcggtgacagaattgaggcagaggacttgtgaggtcacccatagatgaagaacggatccaggcacagaactctggtcttgttaattctcacagctgctcttcttacctcaccaaggctaggagaaaagagcatctagtcaccaaacaaactcatgctacagagactctctagtctctttcataatgcaaaggaaaagaattctgaaattctataccaagctgttaggtgttttccttggattggggaatgtagagggattaatgaggacaggaggcagaccttatcagggtgaaataacatgaaaaaatgaggatgaactactctttcttcatctactacccaacctctcaaataaatttcttgcaaaattaagtgaattcttgcttcaaatactcaaatagaggatttatcttgtttgttccatcttgtgtgatgaatccaggtgttttctaaagcagaaggcacttaatgtaggttctttatttttttgtgctgattaccctaattggtgggtttccttccaggatcagcagccaattctccactagagtagtatcactggaccttagggtctatttacagtagcagatgtagtggtcacccaataaaaaagtcgctgggtgcggtggctgacaactgtaatcccggcactttgggaggccagggtgggcggatctcttgagcccaggagttcaagaccagcctgatcaacgtggtgaaatctcatctatactaaaaatacaaaatttgccagatgtggtgacacacgtctatagtcccagctactccagaggctgaggcaggagaatcacttgagcctgagaggtagaggttgcagtgagtcaagattatgccacggtactccagcctgggcaaaagagtgagactgtctcaaagaaaaacaaacaaaataaatcaaaatattgtttccacagtgcagttttagcctgctgtctcaaaagggcctgagatttgctatatagccaagctgtgtggactccacaggagactcaggattagcaccttagagtcttgactgggttttcttctttaaacgaagctgtagatttagctataatgccatttgtctgcgcttactactggatgggcacagtggattctgattcgtagtcctattcagtgaaaatagccaaatcattgtgaatacactttaatgtgaaatccttcttctgaagagcccagagcaaattcccatgttagggagaggcagatggatggaggcagagttagctctcaatgagttaaaggaatgtcagcatcttcttgactatactggtagctggtagaatagagtgtattccatattgtaaatatagaatacagtcaatctagacccaaagaaagagaaaggaggggcagcaggggatatactaacttatgaacttgagatttataagcattatcaatcttgaattgaaaaagtgaatctcttgagggagtactggtggcattccaaaagctaacccaagtatccatctagtttatagcaaatctaggcacataattcccttagatgatggaattgagatggaggacatggaaaatgatcagacacccttcctgcctggagtgtagctcagaatgaattatctgtggttaagggaggggtcaagggaggaaacggtggtactggtgaggcattccaagggcttggtgtgaggttgcagtaggaagtggattccagcttttgaaaaccactgttacatctacattgccagcagaaagctgaatgcctacatggcattggaatggagtgaggcagattgcaaaggatggggctggccttgaggttggatcatatgtggctgtttctttgactgtcaatcttcattcttaaatcttctcacttgaacaccttttattggcactaaatttgttttaggataatgaacgcagctgttccaattatggtgctcaccccactcacctccatgtttcacctctcaaagacactgcctctcccttgggactagccctgagcatggtgaggccggcatgcccagggctgaggctggcacttggagagccctagcgtcagaggggttaacacattatctgggcatactcaaatagtatgagcccatcaaataaacaaacacaccaacttgcaaatgaatagaaacatgtttattagagtagaggaaaaacagctttttggcacattaaccctgtggcatcaggagtggcagctgcagcctgggacgacaggcagggaggaggagacagtaaacgtgcattttgaaagtgcttaacatcaggagagggtatttccaagcaaagaggtgtgtgtgcgtgtgcatgtgtgtgtgagagagagagagagcgagagtgagagagagagacagagagagagagagagaaccatcaaagcagtacaaaggccaggaggcagtggtagtgtgcacataagacctaggaggatgtgggtttgaatcccgtctctttcaggaattgggtggccttgggccctgtgcctctctgagcttctgtctccacacagttctcttataatctgtccttggcaggcttgtaagtgaagatcatatgagatgacctgttttaagcatctagcacagaactcggcactcagaagctgctggataaatgccactcctcactgtagttctacgttagaatattccaagttttccatggttcctgaggaggaaggcagctgtgtgttcaggtagaaaagtatgaggtgtgggacagtgggaaattctcatgagcaggtttcaattgaggaataattcatttttgcagtaggcagattaattggaaatgataaactcctcccattgtaaaattaagaattaaaagtgtttatttttattcagtaaataccaaaccatgactgtagtatacttgtattccaaactttgatgatttaaaaagggaagagagaaggagggtgaagggaggagagagagagaatggctatgagaaagagagcaagactacattctgagttcctacacgtcatcccctatccccaaaatagcagctccacttgtatacattgataaattttcaatgtagcagttcattggcagagagatgtccaatacctaaaaatagcttgatagctcctagcatagatcatctgccatatcacctgatatttcatcttccccactaaaatgtaagctccctgaaggcagagattaataatgcatataggaggtaatctttgatatttaggatgaggcaatgaatacatgaatgaatacgtcaatgaatgaattaatcaatgaatggagagacaaggagaatcagactctcttggactcagggaatcttatatctttgaacactaaaattatgcttctgtcttttcttgctcttctcaacccaccttgcctgacagtttgttacattgtcaaactctgtcatttcttcatttagcctgcccctatttcactgttagccaaattcttacacccacagagatgatcctcaacctttgtatgttcaactcttgcacagtccacaaatcccccagtgcactccacggaaaccactttgcaaatgccaagcctagccttgtgtgtcgccttgatgaatgagtcaccaccagctgtgctgcccaccagacagcttcttggttccaggggcgccgcctgctttgtcgtatagcagtgttagtacgattgtttgaatacttcactgcattcttcccccacagaaaaatgaaagtgctgataccagtgataaaaaacataggtttcataaacttaacacaattgaggcaaagatggaaatcatttggcgtgcaaaaaagagcaaatgtttagcctcaatcgggtgcttatcatacttgagctatctgattgtgtgctcagctgtaaaggaaaagaaaaaagaaaagaaagagaacagacacaatgcagtaaatattgtcagagattaagtctaaaatatacggtgtattttggattttttttttttaggtttctagaaatgcagatataaatctagttcgttttcactctcaggcatgttttagcaatgtgatgtggtagtgcaaaaacttcttccctgattttcttgtcctactttgtcaaacagattcagctgtgtgtttatattttcaagaattgtagtaatgtcctttcagttgcctagtttttaagaaaacatctttgaaaataaatacttgcaatttttcctactcctcccaacatgagtgtccaccacgagtcccctttcgccaaacacttcatgttcctctgagctgtgctgccccttcctttcctctgtacttctgcatccttagtgttttctcttgaatcctgtcttctccttcatggtctctggaggggacactgcagatgcttaatttgtgaggggaatcacacaaacatagtagaccctaaagaaacatcttagttggattttgaagtgggcctagactccgcgtgtttttttctcaacatctttctttcccttactcaaaatatcctgcagctggggacttctctcactggcgctgttggttgttttttggtttgtttgtgcctcatcagcttcctctacctcattttgtgatcattttgacctaagaccattgcccagtggcttctcatttccaagatctctacttgggtcctttttcacaagtctgtgcttgtctcataactcctagccttgttcatgactgaaatatttttttatctctctgtggacatgaaacctacatatacagtcctattctcctttccctgttagctctgatccctctgatttgagttgttctgtctgttgagcctcttttattttgtttctttatttgatgttcatggtggcgttctttgtgaaatgtttggtgattctggattgaacccatctctgtaacgctgaatgaccatttgtctgcttgttgcctgtccttgcattctgatggaggaagtgggcgggaggtgctgctgctggaatgtgtgctggtttcggtaaaaatggggaaggcgtggaatgtgctatggggcagtgctctggtcctggctgtggtgagtccttgatcctcccaatgtcacctgccttgagaactctgccctgcgaagcggattaagtctccttcctagccttaagccatgcactccatgtctttctgtttggtgtagagatttagcctttctgacttctcccactgcaatgagatgactaatgctgtgttgcttccaaccatctcgagactttcatccccctcttgacatgggcacttgccatggttggttctctctgcttgctatctttcagggattattcaagttcctattcttagtatgtttctcttcccttattttgtgtgggtttggctggggcagggagttcagaaaggaagagaagattttatttagcaagccacctaaaacaggaagttgccttcttcgctgagtctgagacatactgacttccagaacatcacgaaaccaataggatcacagcccagggcctgaatcctcttgtttgaaccttgttgtagatgcacaacctgtgcatttcaaacgtaggaagcagggtgcacagtgggtacttgctctatattgaatgaaattaagccaatgtttcccacaatgtgtgtgatagatattgtgaaaatgtgaagtagaggaggagtgagagggaattcagtgtgctggtggtatcaagcgtgcaaactctgtttaagaactcctttcacaaaagttttaagattatcctttctagcttaaaaaaccaatatagacagaaaagaaaccccactctggtgctttctcccttcttccattcctgccttgaccatcccttcttcctcatagcctagaagcagcctctgggcctccaccttcccttttggttgtcccctcaccctagtctaacacttgcctctttgtagagaggagcttgtcggacacatgggattcacgggccaggtggttcagcagcccaacaacctggatcctcctcaccctcctctcctcatggccagcccagctcagggccgcctctgagagtctggcctccacaaaggaagatgaaatgtagagacgcatttgctgcctccaagtaacagtgcttcaggtgtttacctttcctcaagtcatagaactagagagcagggcgaggccttagggactgtctgttgaccgattgacacattctttgtattttgaaatgaagaaactgaccctaaacccgtcaagtgactttcccagtaagtgtgtggtaccggctgaactcaagttcagatcctaggttagcagtcctataaattgagaaacagaacctcactactcaagccaagctgatgtctaccccaaaccaaacatccaagtatgcactggggtaggtgctttgtgaccagttcccatggactccacttgagagcccttcgaatcctcccccgccccacaccaccccccatcaccccctgccacgagctctgcatcagcctcagagcctggtttgtttcttcagggtatttatgtcaaggattcccaaatttgttattcagttctttccccactgattcccagctccattcctcagccacacaccaagctacacagtgcctcatggactcccctcctgcaatgggttctctggagtccctcctgcagccttttgagggaggtgcctatttcttccagattagagaccctcctgtcctctagatacctgtagctctccaggatcccccagcttcctctagacaagctcatatctcaagcagtgtgcatccaggaggggattcttccctccacatgagacataggccccaggttgagtggcagaactgcctcttcaggccaaaacccaggcgtgctgcctcaacacgaagaccacactttggcattatacgtcttcccaaagttacaatacatccaccccctgggcttcgttctagattctttcaacacttaagtgtcttattacaagtctctttcctgtttagggaacgggcaatgaaattgtgtaggcaaggggtgctccgtttacctggtgcattcgaggctgaagacaaggagacattatcctccaaaatacttttttttaaagcaagtctgccctagagtaaagtcttcctaaattttgattgttactgcgctatgaacagaggttgtatccacatttaatggaacatagcagtgagagaaactggaatattggaactgctgtcctccgctgatgaaaggaggttgtaaataacattttgctgttggtaaacacgcacaataaatacagaaatatggagccatgcaaaaaactttcgactctgtcacatgttattggtggaaaccactcatagaaaatcaaacacagactttgacttgcagtcacagaaatagtatactacctggagtttctttaggatttgcaatctctgtgcggttgcaggctctgcttgtgttatcttttcatgagggtctagacctgagtttgcagaatgattcagaaatcagtgtatttcctgcttcatatagtgtgattaatcttttttgattttacatgtctacaaatggtgttagtggtcataactgcaaatgattgtgatttttattggtctagaatgtgaatgtttgtgttagagcatctgcaaaagcaaacacttttgctatgttgaaaaaataatgaagatctaagtgattttaagatggcattttgtgaatgcatgctaaaatgctgctagatttttatttgttttactgttaatgctgcattgaagatatagtagtgctgcagcacaatttttttctatttcttcttttcctttgtccttcaaaaaatacccattctagttgcaatttttgttcaaaaatcaagatagtcacacactaagataagttcactatctaagaagtaaagaaatgtaaaagtaaagcatctcatagcagttatcagctgttttgtgtcatacataaataacattttgcttagcattggcatattttttgtgtacgttctaatagaatg

SEQ ID NO: 480 - DNA, 7790 bp, Homo sapiens
ggactgctttctcatatatagagtcaaggatttatatattgatatataaattaagagttgtatatatttatgttgtgtgtataattatgttgttcaatcaacagttatttattaaggaactactatttataagatgctatatttgtagctgcagaggttataaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaagaggcaatgaagaggtaggaaagacagtcttgaatcaccacaccatgcctaccccatccgccggcagcagccatgtagtgtggagagatcatctctgtgctgttgagggagagggaacagtgattgtggaactttggattggaactcagttttgccctgtacagtggaagacaacaaggggcaggattcagctgatgcctacagacagatcattttgatcagccctagccagagcggaatcatccattctagcagttggagcctgagttctggctagcaccaccactgtggactaaagtagtctggtgttttaaataaacttgaaagacaatctagaccataagaactaagatttctgggcaagtcctgctctgtgctgggcttggagccagtggatgtgggatgcatgtgacctggtgagacaccagccagggcagccaagggagtgtgtgcatcacccctcctttgaccctaggcagtgcagctcatagctccaggaggagagggtaaagaggaatttgtcttacaacttgcataccagctcagccacaataaaatagtgtaccagagcccccattcgaggcactagctccttgtgccagaaggaaacccactaccttgaagagaaggacccagtgctggcagaattcatcacctggctaaagagcacctgggttttgaataaatatcagtggtacccaggcagtacttgctgtgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagagaccaaggcctggtagcattcaccacaagctgagccttgagtgaacattggtaccaagcctggggtggtaatggccatggatagacactctttctgactgaggaaaggagagggaagggtgggaagaactttgttttgcagcttgggtgccaactcaagtcacagcagaacagtgcactaagtagattattaagtttcctgactccacgcactggctcatggacagcatttctgggccagccttgagccagggagtagcttgctgccctgaagggaggaacacaatcctggctcagtttgcaacctgctgactgaagagcccctgggccttgaacaaaattggcagtagccaggcagtgtggttgctatgagccttgggtgagacctagtaccatgctggctttgggactgacccagagtagtcccagtagtagttgcaacaggggtgcttgtgttacccctcccccagttccaggcagatcagtgtgaaaagagagactacatttgtttggaggaaagtaagggaagagaacatgagtctgcctggtaattcaaggaattctcctggatcttatccaggaccaccaaggagatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactgaataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagttagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaggtacaagaaggttatagaacatcaaatagatttaacccaaataagactacctcaaggaattcaatagtcaaattcccaaaggtccaggataaagaaaagattcttaaattagcaagagaaaagaaacaagtaacattcaaaggaactccaatacattggagcagacttctcagtggaaaccctacaggccaaaagggactggtgcaacatatttaaaatgctgatggggggcaggtggtgggggctggggaggtggggaacaacttttatcctacagtaacatattcagtgaaaatatccttcaaacataaagaagcaacaaaactttcccagataaacaaaagcttaggatttcatcaatatcagatgtgtcctatgggaaatgctagtttttcaatctaaaagaaaaggatgttaacaagcaataagaaattatctgaaggtacaaaactctctggtaatagtaagtaaacagacaaatacagaatattatagcactgtaattgtgtgtaaaatatttatattttgagtagaaagactaaaagatgaacctatcaaaaataataactccaataacttcttaagacataataacataaatagaaacaataaaaagttaaaaagtgggtggatgaagttagtgtagagttttcattagttttctctttgcttgttagttcatttttgcaatcagtgttgtcatcagtttaaaataatgaattataagatattatttgcaagcttcatagtaacctcaattccaaaaactgacagataaaaagtttaaaaatgaaattaaaacataccatcagaaaaaataatcttcacaaaaaggaagacaagaaggaaggcaagaaagaaggaaagatgacaaaacaaccagaaaacaagtaacaaaatggcaagattaagtctttacttattaataataatattgaatataaatggactaaactctctaatcaaaagacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaatatatatacacccaaaactggagcacctagacatgtaaagcaaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgaccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaaagttggtgttttgaaaagataaacaaaattgccaaacctttagccagactaaaaaagaagagccaaataaataaaatcagagatgaaaaaggagacattacagctgatactacagaaattcaaaggatcatttgtgactactatgaacaactatatatatgccaataaattagaaaacctggaagaaatggataaattcctagacacatacaacctatcaagattgaaccaagaagaaattcaaaacctaaatagtccaataacagtaataaaattgaaaccatagtttattgtacattgatgaaaagtttcctggcctagtaaagcccaggactcaatggtttcactgctcaattttacaaaacatttaaagaaataataccgatcctactttaactatttcaaaaaatggaggaggagggaatacttccaaactaattctgtgaggctaatattaccctgataccaaaaccagacaaaaacacatcaaagtaagaaaactataggccaatatccctgataagcattggtgcaaaaatcctcaacaaaatactagcaaaccagatttaacaacacattaaaaagatcattcatcatgactaagtgggatttatccctgggatgcaaggatggttcaacatatgcaaatcaatcaacgtgatacaacatatcagcagaatgaaggacaaagccatatgatcatttcagttgatactgaaaaagcattggataagtcactattacttcatgataaaaaccctcaaaaaactgggtatagaaggaacaaacttcaacacaataaaagccacatatgacagacctatggctagtatcatactgattggggaaaaactgaaaggctttccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaatcaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccatcttgagcaaaaagaacaaaactggaggcatcatattacctgacttcaaattataacacagagctatagtaacccaaatagtatagtactagcataaaaacagacatatagactgaaggaatagaatagagaacacataaataaatccatacatctacagtgacctcattttttataaaggtgccaagaacatacattgaggaaaacacaatctcttcaataaatggctctgggaaaactgatatccatatgcagaagaataaaactagacccttatctctcaccacatacaaaaatcaaatcaaaatgtattaaagacttaaatctaagacctcaaactaggaaactactaaaagaaacagttgaggaaactctctaggacatcggtctgggcaaagatttcttgagtaataccccacaagcacaggcaaccaaagcaaaaatggacaaatgggatcacatcaagtgaaaaagcttctgcacagcaaaggcaacaatcaacaaagtgaagagacaacccacagaataggataaaatatttgcaaactattcatttgacaagagattaatatcaagaatatataagaagcccacacaactcaacaggaaaaaaaaaatctaaaaatccaatcaaaatgggccaaagatctgaatggatattttttgaagacatacaaatagcaaacaggcatatgaaaaggtgctcaacatgacagatcatcagagaaatgcaaatcaaagctacaatgagatatcgtttcaccccagttaaagtggctttaatccaaaaggcaggcagtaacattcccaccaacagtgtatgagagttggagaaaaaggaaccctcttacagtgttggtgggaatgaaaattagcatagccactgtgaagaacaatttggaagttcctcaaaaaactaaaaatagagctatcatatgatcaagcaatcccactgctggatacataccgaaaagaaaagaaatcagggtatggaagagatatctgccctgttatgtttattgcagcactattcactatcacaaaagacttggaagcaacctaagtggccataaacagatgaacagttaaagaaaatgtggtatctatacacagtggagtactattcagccataaaaaatgaatgagatcttgtcatttgaaacaacatggatggaactggaggacgttattttaagtgaataagccaggaacaaaaagacagactctgcatgtcctcactaagttgtgggagctaaaaatcaatgcaattgaattcatggatacagagagtagaatgatggttactagaggctgggaagggcagtgagtggcagaggggtggaagtgggaatgagtaaagtgtacaaaaatatagttagatacagtgtataagatctagtatttgatagctcaatgatgctattttttccatttgataacacaaatactagatgaatgtagggtgactacagtcaaaaataatttattgtacatttaaaaataactaaaagaatacaattggaatgtttgtaacacaaataaatgataagtgcttgaggagataaataccccatttaccctgatgtgattattacacattctatgcctgtatccaagtatctcacaccctgtaaatatatacatctaccatgtacccataaaaagtaagaataaaaaaataa

SEQ ID NO: 481 - DNA, 7930 bp, Homo sapiens
ggactgctttctcatatatagagtcaaggatttatatattgatatataaattaagagttgtatatatttatgttgtgtgtataattatgttgttcaatcaacagttatttattaaggaactactatttataagatgctatatttgtagctgcagaggttataaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaagaggcaatgaagaggtaggaaagacagtcttgaatcaccacaccatgcctaccccatccgccggcagcagccatgtagtgtggagagatcatctctgtgctgttgagggagagggaacagtgattgtggaactttggattggaactcagttttgccctgtacagtggaagacaacaaggggcaggattcagctgatgcctacagacagatcattttgatcagccctagccagagcggaatcatccattctagcagttggagcctgagttctggctagcaccaccactgtggactaaagtagtctggtgttttaaataaacttgaaagacaatctagaccataagaactaagatttctgggcaagtcctgctctgtgctgggcttggagccagtggatgtgggatgcatgtgacctggtgagacaccagccagggcagccaagggagtgtgtgcatcacccctcctttgaccctaggcagtgcagctcatagctccaggaggagagggtaaagaggaatttgtcttacaacttgcataccagctcagccacaataaaatagtgtaccagagcccccattcgaggcactagctccttgtgccagaaggaaacccactaccttgaagagaaggacccagtgctggcagaattcatcacctggctaaagagcacctgggttttgaataaatatcagtggtacccaggcagtacttgctgtgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagagaccaaggcctggtagcattcaccacaagctgagccttgagtgaacattggtaccaagcctggggtggtaatggccatggatagacactctttctgactgaggaaaggagagggaagggtgggaagaactttgttttgcagcttgggtgccaactcaagtcacagcagaacagtgcactaagtagattattaagtttcctgactccacgcactggctcatggacagcatttctgggccagccttgagccagggagtagcttgctgccctgaagggaggaacacaatcctggctcagtttgcaacctgctgactgaagagcccctgggccttgaacaaaattggcagtagccaggcagtgtggttgctatgagccttgggtgagacctagtaccatgctggctttgggactgacccagagtagtcccagtagtagttgcaacaggggtgcttgtgttacccctcccccagttccaggcagatcagtgtgaaaagagagactacatttgtttggaggaaagtaagggaagagaacatgagtctgcctggtaattcaaggaattctcctggatcttatccaggaccaccaaggagatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactgaataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagttagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaggtacaagaaggttatagaacatcaaatagatttaacccaaataagactacctcaaggaattcaatagtcaaattcccaaaggtccaggataaagaaaagattcttaaattagcaagagaaaagaaacaagtaacattcaaaggaactccaatacattggagcagacttctcagtggaaaccctacaggccaaaagggactggtgcaacatatttaaaatgctgatggggggcaggtggtgggggctggggaggtggggaacaacttttatcctacagtaacatattcagtgaaaatatccttcaaacataaagaagcaacaaaactttcccagataaacaaaagcttaggatttcatcaatatcagatgtgtcctatgggaaatgctagtttttcaatctaaaagaaaaggatgttaacaagcaataagaaattatctgaaggtacaaaactctctggtaatagtaagtaaacagacaaatacagaatattatagcactgtaattgtgtgtaaaatatttatattttgagtagaaagactaaaagatgaacctatcaaaaataataactccaataacttcttaagacataataacataaatagaaacaataaaaagttaaaaagtgggtggatgaagttagtgtagagttttcattagttttctctttgcttgttagttcatttttgcaatcagtgttgtcatcagtttaaaataatgaattataagatattatttgcaagcttcatagtaacctcaattccaaaaactgacagataaaaagtttaaaaatgaaattaaaacataccatcagaaaaaataatcttcacaaaaaggaagacaagaaggaaggcaagaaagaaggaaagatgacaaaacaaccagaaaacaagtaacaaaatggcaagattaagtctttacttattaataataatattgaatataaatggactaaactctctaatcaaaagacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaatatatatacacccaaaactggagcacctagacatgtaaagcaaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgaccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaaagttggtgttttgaaaagataaacaaaattgccaaacctttagccagactaaaaaagaagagccaaataaataaaatcagagatgaaaaaggagacattacagctgatactacagaaattcaaaggatcatttgtgactactatgaacaactatatatatgccaataaattagaaaacctggaagaaatggataaattcctagacacatacaacctatcaagattgaaccaagaagaaattcaaaacctaaatagtccaataacagtaataaaattgaaaccatagtttattgtacattgatgaaaagtttcctggcctagtaaagcccaggactcaatggtttcactgctcaattttacaaaacatttaaagaaataataccgatcctactttaactatttcaaaaaatggaggaggagggaatacttccaaactaattctgtgaggctaatattaccctgataccaaaaccagacaaaaacacatcaaagtaagaaaactataggccaatatccctgataagcattggtgcaaaaatcctcaacaaaatactagcaaaccagatttaacaacacattaaaaagatcattcatcatgactaagtgggatttatccctgggatgcaaggatggttcaacatatgcaaatcaatcaacgtgatacaacatatcagcagaatgaaggacaaagccatatgatcatttcagttgatactgaaaaagcattggataagtcactattacttcatgataaaaaccctcaaaaaactgggtatagaaggaacaaacttcaacacaataaaagccacatatgacagacctatggctagtatcatactgattggggaaaaactgaaaggctttccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaatcaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccatcttgagcaaaaagaacaaaactggaggcatcatattacctgacttcaaattataacacagagctatagtaacccaaatagtatagtactagcataaaaacagacatatagactgaaggaatagaatagagaacacataaataaatccatacatctacagtgacctcattttttataaaggtgccaagaacatacattgaggaaaacacaatctcttcaataaatggctctgggaaaactgatatccatatgcagaagaataaaactagacccttatctctcaccacatacaaaaatcaaatcaaaatgtattaaagacttaaatctaagacctcaaactaggaaactactaaaagaaacagttgaggaaactctctaggacatcggtctgggcaaagatttcttgagtaataccccacaagcacaggcaaccaaagcaaaaatggacaaatgggatcacatcaagtgaaaaagcttctgcacagcaaaggcaacaatcaacaaagtgaagagacaacccacagaataggataaaatatttgcaaactattcatttgacaagagattaatatcaagaatatataagaagcccacacaactcaacaggaaaaaaaaaatctaaaaatccaatcaaaatgggccaaagatctgaatggatattttttgaagacatacaaatagcaaacaggcatatgaaaaggtgctcaacatgacagatcatcagagaaatgcaaatcaaagctacaatgagatatcgtttcaccccagttaaagtggctttaatccaaaaggcaggcagtaacattcccaccaacagtgtatgagagttggagaaaaaggaaccctcttacagtgttggtgggaatgaaaattagcatagccactgtgaagaacaatttggaagttcctcaaaaaactaaaaatagagctatcatatgatcaagcaatcccactgctggatacataccgaaaagaaaagaaatcagggtatggaagagatatctgccctgttatgtttattgcagcactattcactatcacaaaagacttggaagcaacctaagtggccataaacagatgaacagttaaagaaaatgtggtatctatacacagtggagtactattcagccataaaaaatgaatgagatcttgtcatttgaaacaacatggatggaactggaggacgttattttaagtgaataagccaggaacaaaaagacagactctgcatgtcctcactaagttgtgggagctaaaaatcaatgcaattgaattcatggatacagagagtagaatgatggttactagaggctgggaagggcagtgagtggcagaggggtggaagtgggaatgagtaaagtgtacaaaaatatagttagatacagtgtataagatctagtatttgatagctcaatgatgctattttttccatttgataacacaaatactagatgaatgtagggtgactacagtcaaaaataatttattgtacatttaaaaataactaaaagaatacaattggaatgtttgtaacacaaataaatgataagtgcttgaggagataaataccccatttaccctgatgtgattattacacattctatgcctgtatccaagtatctcacaccctgtaaatatatacatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgtt

SEQ ID NO: 482 - DNA, 12282 bp, Homo sapiens
cgtaggcctttacatatcacatatctttttgttctaaatttttttctagccacgtatgtgatgatgaattaatatacactatgattaataattataaaggagcagcctgttctattgtacagagctgtggtttgtcaccatcgctgcctttgagaatctcctggggagctgttttaagtactgatgccagagtgccagcctccagagattctgatttaattggtctggtgtgatacgagatcattctttttttaaaagctccctagggtttcagaagtgcagcacaggttgaaagctaccgatatagagcaaagctttactaaaagctgatatgtggaagcaaagaatgtgaaatgactcctgaaggcaccaaactgacaatgcaaatcaaatccaagaacaagctctaaatgtgtgcttgtattttactgaatcccttttgtaaacccatgcaatattttaccccaatattattgcaatacaaactgggaaagataagatactggaatgtaacctgcatcagacagatagcaatatctcattgatttagagcagagcagaccaagttttggagtagagggagtagttcgatgactggcagagaagcgggtaagaatttaaagacaatagtagaatcattatctctctgctaccctgttgggacaaagctctctaaaataagcaactacacagaaggaaaaaaatggtcatttgaccatacgtattttgagagaaacaattacttttttaaaaattttaaagtgtggatttgaatttaatttttttatacaaatgaagtacttttgaatacagagctaagagtatattcttgacagcttgaaatagcttcttcattttcctctttgatgcccatatttgtatttcattgttttcataatttagagtaggcattattgtttctaaaacgaacataaaagcaaaacataaaaatcaacaacatgtaaatattttagtgtcaacagggaaatctctaactgtacataagataaaatatctattattttaaaaataatacataccttaaaatcatactctgaaaagactgaatcaagcaaaaaaaaagcttgatgaatgtccacataaaacagtgggaagaaaatatgtttaaaagtacatttactaacaaaacatgttcaaggtccatatgaggagaactgtaaggctctaatggaaaaatcaaagaagaaccaaatgaatgaagagatactccatcttcatgggtaggaagactcaatattgtcagcatatcagttatttccaacttgatctatagattcaattcaatcccaatcaaaatcccagtgacttagttggtggattttgacacactgatactaaagtttacacggagaggcaaaggtccaagaatatccaccacaatattgaaggagaaaaagagtgagaggactagcactacccaacctcaagactcactatacagttaccataaccaagacagtgaagtattggtgaaggaatagacagatagatcaatggagcacaggaaagagcaaagaaatagacccacataaatacagtcaactgacctttgacaaaggaacaaaagcaatacaataaagaaaaagtagtcttttcaactaacggtactgggacaactggaacgtccacatgcaaaacataaatccaaacatagatcatacgtccttcataacattaacttaaaatggatcacgtaaataaatgtaaaatgcaaaattataaaaatcctagaaggtaacctatgagaaaatctagatgaacttaggttgtgctatgactttcatatatgacaccaaaggcatgattcagggaagaaataattaataaactggacttcactaaaattaaaaatttctgctttgcaaatgactgtcaacattatgtgaagagaaaccacagactgggaggaaggttttttttgcaatagaaatatctgattttaaatatacaaatatctcttaaagcccagtaataaaaaacaatgcaagttgatttaaaaatggaccaaagaccttaacagataagttgccaaagaagatatacagatggcacataaacatatgaaaagatgttccacattatatgtcatcagggaaatgcacatcaaaacaaccactgcacgcctatttggaatgctcaaatccagaaaacttacacaatcaaatactgacaagaaagtattagacaacagaaactctcattcactgctggtgggaataaaaaaaaaatggtacaaccactttagaagacagtttgatggtttctcataacaactaaacattgtcttactacatgatccaccagtcatactccttgatatgtaccctaaaatgctaaaaacttctgtctacacgaaaacctgcatgcaaatatctatggcagctgcattcataatttgccaaaacttgaaagcaaccaagatggccttcagtaggcaaatggataggtaaactgtggaacatccaggcaatgaagtattattcatctctaaaaggaaatgagctgtcaatccatgaacagacatggaataaacttacgtgtgtattactaagtgaaaggagccaatcttaaaagcctacataccacatgattccaactgcatgacatactgtaaaaggcaaaacaatggaaacagtaaaaagatcagtggttgccaggaaatggggtggggaaaagaatgaacaggcagagcacagaagatttttagggcagtgaaaatactctgtatgatactataatcatggatacatgtcatcatatatttgtccaaacccacagaatgtataacaccaaggataaaccctaatgtaaatgatggactttgggtgctaatgatgcatcatgtaggttcatcaattgtcacaaatgcaccactctggtgggggatgttggtaacaggagagactctgcatgtgggggcaaggggcataaggggaatctctgtgccttcatctcactttttctgagcatctaagagtgctgtaaaaacataaaagtctttttttaagtacatttatatcaagattttattcctgtggattttcctgcattcacaacggaagaatcacttatgaattgtttgggtctaactgtaatttttgtacaaaccattcattgtgggctaatgtgtgctgttacattaatgctgttagtaattccctcatgtttgctatatatttttatctttacctcgttattgtatatattagtgagactacaaaacacaaacattttaactgaaatattaaatactgttttataagtgggattcattaaaacaaacatttggataatgaatgacaggttaaatttcatttaatgattaataaaataaatattgcactaaaaaagaatagcctgaaatactagtattagtcctattatctcagctcagggttgaaagtacttaaattattaataagacaaaacagtcatctaattgttttcttttcttgtatgacatttctgtaactacagaacaagaaagaaatgtcaattatatatcaatgagtaattcctgttaaagtgcatagtgaaaaataccaagtaagaaactacaaaagctaaaatgggttagcataatagtaagatactaaacctgatgcttttcaaaaaattgttaatttggagcaaatggacagaacacactgcatttataaacaacctaatcaatagtactcaaatatctactgcagtgttctaggaacattatttaaatcaaagaatgacatagaactatcaaggaactaacttattgaggaaatatacaacaaatagtaacaaaatgcacagatttaaaactatattaaacaaacaaaacacacagatttaaaattatattaaactatattaaattatattaaactatactaaattaaattaaaactgtgtgaatattttcaatctagtaaaatcaatgttgagttaattgatctaagatattgtagaggatgcttaatgcttaaatatcttagcatgggggctgtagtgcagaaggatgtttggtgcaaatcagcatggatcttcatattctttcccatggaaagattcaagcccctacagtgttagctccacttggcaccgtatttcattagcagtgtggtagcattctatctctacatccacaaagagagtagaagaaagctttggcaaatacattgaggctaatgagacacatgatgaaaggttaatttaacatgttacaaggctttaatcgtcaatgtgaaaaatgcccccccacccaagtattgacctgagaaaagatttctcctcattatggctaggctaaaaatcaggattaaagcattagtagattattatcactcatgtggcccaattttgttgagtagtaagtctgtgcacacaactaaaatgaacactttaaatatggcattgacagcttcaataaaattatacttgtagtaaattttagacttcaggcaaatacacatctggatgcttactcaatcagggttgttgtaatattgaatattaatctggcccatagataaattacagcctgattttctgatctatgaattcaggaaatgggctgaaaacatttttaggtaaaactttccgaagttttttcaacttgagttgtgtggaattctagggattctgcatacttggttttagattccttttttttgaaacacattttaatgatttttgaaataaaaatatacatactttaaaggagagggattaaaatttttctcttaaatttgagagtttagacaaactctcaagttaagtacttgtaccacctttccagcccatatacatgtataaaacaatgttgtcaaacagatgttattttctgtctgctcttgatacatttcaataaaatacataagtaatatattcaaatacaacagccattcacattcacaggaaagaaaaggcattgttgaaataagacatgaattattgtgttcaggaggacattggggaggcttcctagaccagagaaaatttggctatagttatgttatgtcacatatacattatgtgacaatgaagcaatattaaaaaagaagaacccacaaataactcaagttcaaagacaaaaataaattctagctttaaagttaaaagctgaaaagtgccagaattttctaactgcacaatctaaaagccaatccattgttgcctgctaattaagccaccacggggtttcatataattaatagcaaatcgtctctgaatggaaaaataaaatagttgcaacatgcctttacatagacatgcattttagacagtctgtctttaaactatagtatcaggacagactttccatgtagaagagatgattaattatgtcttgggttgggtgctctctttattttcttttctctcaggctagaaaagctttggtttctataattacttctcatttatctctagttaaatgtgggcgaaattttctattaattaaatttgaattcactctaattggtaagtttaaaacgacaggaataaattatagcacatattgcaacccaaataaggctgaattaaacagatacattatgtggcaatgaagcaatgttaagaaagaagatcccacaaattcttcaagttcaaagactaaaataatttctggcgttctgttaaggttagaaaataaggattctcttttattaggcaaatgtttggaagaagcatttgaaggctaccacttatagaatcaaagataattttcctacacagagcagaaaaagaggactcaccgaagactccaaattatgaactatttttaatcatttatttggcttagttatttataatcaatttactctgttgatttctaaacataaaaaatatatagatagcaaatggactatcagggacttcatgaagccattgtttttgattaaggaaaggtgtggtagctattctgcttaagtggcccctgttgtatgaattttgcaccaatgtttgctgatgtatttccttcctttagtgaagcaggaggtgatgcctatcagtaaatatcagtagacatattctgcattttcttctctccacactcagaaggaaagaattttaaaactcagcctcgcattttaaaacatattgaattataaaacttttaatgcagggaaatccctcagaaattctccagcctgatttcctcatttcacagatgagtaatcagttgctctgggagaggatgttatctgcccaaggtcacttagctaataggaaatctaatctgcgactaatgacaaatgtgtgctctttctttcacaccaagcacttgtgggcattttttttttcttgtcagtgatataggtgaacacaatttcataaaacttgcagatggacagaaactgagaggaagatctaatgtgtgagaaatgataaaataagagttcaaaagaaggttggcaacttagagaggtagaaagaaaatggcaaaatacaattttatagaaatcagtgtagagttctcctctgagttaaccacacatgcacagactcctcacacatttagttatggaatgaagaaggtacatcttaagaagagcttgtaccaggacagctagttgcagaaagactagcttaagtgggtttcatgaatccaagtgcagtgtctgctgtactgaagttaatggtctgttaatttggtttagagacagaagacttgggctaaagtcccaaccaggtgtgagtattatctgggtatcatctgtaatttttaaaaatgtattcctcccatactagatcataagagctagaaggggggcaccattcttgatgtattatctcctatatcctaggattttgcgctgtgccaagcatacagtagacactccattagtacttgttaaatcaattattaaggtaatgtaacttatcctctctgagccccagttttctcatttataaaattaagaacctacagttgtgaaagtgttttggaaactccaaagtgctgtggtaacataagcaattgctactgtcattgagaaatgctaccaataatacttagagaatttgatacaactcagtctgaaaaagctaagattagcagaacagagctgtctccaaatatttgaagaactattttatttaagggattggacccatttttgtatgtagttccagaggagcagatggtgaccactgtccaggcagatgtgtctcaatgtaaggacaacatctgtaatattaataattagaatgtatcctgtaattttctctctacccttggaaaccagtcgagatccagagtctttcactgggaggcttaaagcctagagcagccttggtgctagaggcggacagggataatgaactaatcttgaaccaattcatccatagcaatctcaatgctttcgttagctcttataggtatttaatacggccagaggaatgaaggtagtcttgctggtttagaagccctgcctaccacaacccctacaccaccccatcccctgcatagtctgatgtcatcactagtggaaatgtttaaacagcagtgaatatgcatgatagacagaatcttgcattggataaagagtgaatctttgaatttcaaggtcatattcagctgaatataagctagagaaattggaacttatgaaggtggtgatgaatacatgagcttaaaaaggattggaaagggccaggcacggtggctcatgcctgtaatcccagcactttgggaggctgaggcaggaggatcacatgaggtcaggagttcaaaaccagactggccaacatggtgaaaccgtgtctctactaaaaatacaaaaattagccagtgagccgagattgtgccattgccctccagcctgggcaacacgaatgaaactccatctcaaaaaaaaaaaaaaaaaaggattggaaagaagagatatgaacttctctttttgcttccctgaagtagagaaagcagagcttaagaaacaatttatatggactatgtgttccaacttcctaaaaatcaccatataaaattctatgtaggaaataaaaataattgcagattaacacagtttatatattaatcacatcagtttataaatataatgcacacacatgaaaaacacacaaaaatgtgtgttctaataaagaaattagatagaacagttcttaatttacttattttcattttggcacttctgtgaacttggttgtcaaatgcattaacccaaagaaaacttagcaatttgatgaaccttgaatccatttagaatttgtcttctctgctagaaaaagagaatgtatgtttttagaaaaacatttggcccacagatgatatgagaaaaagcttttcccatttaaatagctgctatttttataaatggaaccacatcaactcttccataaggagaaaacacactcttgtgaagagccgagaatttctggggtgagtgtgtgtgtgtgtgttagagttgccaagtagctttcccttacatttaagcaacatatcttaggaaagaaaagagatgcacttagagttatttccctgtccctgtgcaggttagtatagcagagtggaggtcttaagggaggatagggggcctagggaaaaagtgtaatgatgcctaaaggatttcctggaagttggcaggtaatgtgaaatgaaattggaagggtgaggaggctgtgttccccctgatgccagtgtgtgctttcatttgatattaatagttattgagccaagggggaaacatctttaccttgtaaaataattcattgctatcaattacgcacatgagctagaatgttcaggccacgttcacaaacttctcaattagaaacgctgtatttctgaaagtaattataaaatacattgcatggcaatgtttttccaagataaagaaaaattcatggaagcgttacacaactttctgaaattcaaaaccagcctagtcaacagggactaccttctacagattcattttcttattcacgtggtgcgcttacgagttccattaatatagatgaacattacacataggtatccagaaaagacatctgaggccttccacacttcacattattatcagtggggatatcagagggcagctttctttctgcatcatctctctgagtgaaagctggttatttaacttcatttgtcagctaatcagccagaacgtgaagctattaaaatttagaactgtcctctggaaaggtagatgttccgtgaaacgccaaaatgaaaattacctggtgttatgatgaccaccttaacttgaagccatcatcattaggatgcatttctcaaggcagcgtacagggcacacatggataatcatcagactgtattttcatctgaagcttgccattcagggactccatcctcagttctgggacaatagactaaatcccctctcaatttatacaaatcagtgtcagatctcagctggcaaaaggcagccttcgagggtgtctccttcaaaatggagaagaccacagctccagctagagtcactgaaaggcaagaagagcataagaaaatcccagctgcagaacaaaacgcatggttcttccacagcacatctcattgctgagatctggtcgcatgaagcatgttctatagctactcttctgtgtctcctggtaatttatgtgcaatactgtcttagtacattcggtattctttgtacattcaaaataccatgaactgggtggcttctaaacaacagaaatttatttctcacagttctggaggctgggaagttcaagttcaaggccctggcaaattcagtttttggtgagggtttccatttcatagtcaatgccttctttttgtgtcttcacagggtggaaagggcaagggttgtctctcaggccttttttaaaatgaagttgttaatcccattcatgcaggtgtcaccctcatgacctaatcaactcccaaagacctttgttatttggcttctagttatagatgtttcaaaaggcgaagtgttgtaccttttcaagctttgtatagtactatcatctgactgctttattcccccaaaattcatatgttgaaatagtcatctcaaaggggatggtattagacagtggggcctttggcaggtatttagtatttgtcttaacttttcatctaacttctaaattcctggccctgagtaccattgttttgtagcccctattctacctagatttctctggatgggagtcagtgcaaacttcttttgttataagaaggttgtattctgtcactagtgagtaacggaggaagagcaattaagaatggccttttattaagatgccagcctttgttgagcagtcttggtaatatcataatttgcaaaattcagaagctgatgtgagagttccagggctgtcaccaaaacccaggtttgacatctgaatttaactgacactgtttgcctgctttgaggctgtccttccattgtgtctctaactgcaaatgagaatgactccccgagggaagcctttgggatcacagatgcatcaacatctgggaatcaaatctctttcaattacattaattatctgctatgtgcaggagaaagttttgaatctaaaataacattaatttaatctcaaggttagagagagattttaaacttcctttaaaccccaaaatgccgaggcgggtggatcacccgaggtcaggagtttgagaccagcctgaccaacatggtgaaaccccatctctattaaaaatgcgaaaaaattagttgggcatggtgagaggcacctgtaattccagctagtcgggaggctagggtaggagaatcgcttgaacccaggaggtggaggttgcagtgagccgagatcgcaccattgcactccagcctgggtgacaagagcaagactccatctcaaaataaaataaaataaaacccagaggggaagaatctatatgcacactgtaatgaaactgtgataaaacatatgctcggaagcacatccttgaggtacttcgtgagagtgcctggtaaatcaaatgtctgggatgcttgcttcagtcagtgaggcaaaggaaagtccggctgccaaattatttacttaagaagtggttataatgttattttacccagttggaactgtctgcctatactagcttagtgctcaatacagttcaattctgttgatcatttttttcgaaatctcacgtacattcttctcatctaaagatgcccgttgccatcgctaagccaccctattgtccatctcttcccagtacaacccacaccatgtgaatgttgcaacaccacttccatcatggttcatcatggttctccttgtgtaagtagctcacctattgaagcaagcctaaacctccatcgccttgcctcagtctgcagctgatggtcttccacaccattcctgcaggcagcctcttcctggcagtcaggctgggctccttgctgaatggtctgtacagtgtgctccttggtacctgttttgcttttacctatgctatggtcactggctgtaacatccttctcctgtcctgcttcccatggtcaaatgtttgtcattctcaaggtccttttaggttctgccccacctggctctttaggcccacacaacctctccccgtttctaaaaagtgtttatagattacagcatgaattttgctgtggttgtgtgtttttatgagcatgtgtgactatgtatgtatctatagatagacactgcttgtaatttcttaaagaaaacagcttctgcttgttttgttcaaaatgtctgaagccaattgtttttgtttgcttttagaaaaaaaaaaaactgacatcaaggagagagcataacacagcccccactaccaccaattatgcagccgagtgagtttcccacatttggggaaatcacggaaatcagcacatcagaatgcaatgggtaagctcaccctgggaaaaaccattttcatgatcatgccatctcccctgccgggtaagaccagtctgtgaatttctctgttgtcataacatatgcccagcaaacatggatttgttatgttctacctcacttctagtgagatatatcacttaatgaaataagtgactgaaaagtcacagaagatttcaaagcaccatgttatctgccctcccttgcctcctagtccggaatcaccccctttagttatctcacctccctttatgtgatattaaagaatcatttgaaaaggccagaggttgtagctgggatcaaaagtcaggcagacaaatatgtcatgtgtccatattaacaacaatacacgtttcttcctgatttagaaatcaggctatagtttcacaatagtcaaaaacc

SEQ ID NO: 483 - DNA, 73812 bp, Homo sapiens
accatgactctcagatattgacacctggaaaaatacaactattcattaaacaagttttgaattcctaatgtggcaggtgtcatgttagacactggaaacacaactgtaaacaagatagatttagtttacatcttcacaaaatattgaagtaaagggaatacttctaaacattttatgaggccaacattaccctgatataaaagctagaaaacgacactacaagaaaagaaagttacaggccaatatccctgatgaacacagatgcaaaaatcctcaacaaaatatcaccaaaccaaattccacagcacattaaaaagattattcaccatgattaagtgcaatttatcctagggatgtgaacatagttcaacataaaaacatgatccaccatattagtggaatgaaggataaaaaccgtatgatcatctcaacagatgctgaaaaagtacttgaaaaaattcaacattctcttatgataacaattcttaataaattagatatagagagaatgtctcaaaacaaaaaaggctgtatatggcaagctcacagctaacattatcctcagcagggaaaagttgaaagcttttcttctgagatcaggaacaagacaatgatgcccactcttctcagttctattcaacaaagtactggaagtcctaggcagagcaattaggcaagggaaagaaataaaaggcatccaagacagagatgaaaaaattaaatcagccctgtttgcagatgatacattcttaaacattaaaaactctgaagacttcaccagaaaactgttggaactaataatttggtataattgcaaagtacaaaatcaacattcaaaaatcagtagaatttctatatgctaactatgaactatcagaaaaagaaatcaagaaagcaattctgcttacaatagctacaaaaaacttaaaatacaattacctgctgcacaatgaatttggttaatgacagaaaacatacaagacagtggccctataagattataatcaagctgaaaaattcctatcatcttagcacaatgcatttctcatgtgtttgtggtgattctggtgtaaaaaaacctactgtgctgccagtcatctaaaatatgtaacacatgcaattatgtacagcacataatagttgataattataaaaacaactgttatttggcttatggatttactatttatccaactggcttgtggatttactatacattttatcattattttagagtgtactcctaactataatagacaagttaactgtaaaacagcctcaggggagtccttcaggaggtcttccagaagaaggcattgttatcataggagatgacagttccatgcgtgtgattgctcccgaaaactttccagtgggacaagatgtggaagtggaacacagtgatattgaagatcctgaccctgtatatgcctaggctaatatgtttccatcttagttcttaacaaaaacatttaaaaagtaaaaaaagtaaatgaataaattctagaaaaaaccttacagaataagaatataaggaaaaatatttttatagagctgtgcaatgcgtttgtggtctaagctaagtgttattacagaagagtcaaaaatttaaaaataacaaaaattttatgaagtaaaaaagttatagtaagataaggttaattcgttattaaagaaaaatatttatttttaataaatatagtgcaacctatgtgtacagtgattatgaagtctacagtagtatgtcctaggccttcacatccactcaccactcactgacttacccagaacaacttccagtcttgcaagccccgttcatggtaagtgccctaggcaggtgtatcactttttaatcttttataccatattttaatgtaccttttctatgattagatatgtttagatacacaatcacttaacactgtgttacaattgcccacagtattcagtacaggcatatgttgtacaggtttgtggcctagaagcaataggctatgccacatagcgaaggtgtatggtaggctataccatctaggcttctgtaagtattctctgtgatgtttgtacaaagatgaaattgtgtaatgacacatttctcagaacatatccccattgttaagcaacacacaactgttttggggaaaaaatttaaccaaggaggttaaatatttgtacactgaaaaactgtaaaacattgatgaaaaaaattgaagacacaaataaatggaagacacaaataaattgaagacacaaataaatccatgaacatggattggaaaaattaatattgttaaaatgtccatactttccaaagcaatctctatcaaaatgacatttttcacagaaatatccaaaaaaaatcttaagttttttttatggaaccacaaaagaaccctgaataaccaaagaaatattgagcaaaaggaacaaagctggagccatcacattacctgacttcaaagcataccacagagctatagtgattaaaacagcaaagtactatcacatagagtaatagaacagacacatacatcaatggaacagaatatagagcatagaaataaaaccacatatttatagtcaattgaggacaaagatgtcaataacacacaatggggaatgaacagtattttcatacatagtgttggaacaactggatatccacatgcagaaggataaaattatatgcttatctcatgccatatacaaaaattggctcaaaatggaagacttaacctaataaatcttaaacatttgaatgtatgacacaagttataaaccactagaagaaaacatagaaaaaaagctctgtgacattgctccgggcaataacattttggatataaagccaaaagcacaggcaacaaaaacaaaagaagacaaatgggattatatcaaactaaaaagcttctgcacagtaagggaacaatcaacagagtgaagagacagtctgtgaaatgggagaagatatatgtaaatgcatttgataaggggttaatatctaagatacacaaggaactcatatacctcagtagtaacaaaagaatgaaattcttaaaaacaggtaaaggatatgaatagttatctctcaaaaggagatacacatggctaacaggtatatgaaaaatgttcggcatcactaattatcaggaaaatgcaaactaaaatcacaatgagatatcaccacacacctgttattttggtgatcaaaaagatgaaagataacaaatgttggcaaggatgtagaaaacagaaaactcttccactgtgttggaaggaatgtaaatgaatacagcttttatggaagacaatatggaggttcctcaaaaaattaaaaatagaactatcacatgacccagcaatcccactactgggtctgtatccaaaggaaattaaatcactatgtcaaagagatttctgctcttccatgtttactgcagcattgttcacaatagccaaaatatgaaatctacctaagtacccatgaacaaatgaatggattttttaaatgtggtatatatatacaatggagtattattaagccttaaaaacgaaggaaatcttgtgtttgcaacaacatggatgaacctggaagacatttatagtaagtgaaataagtgaggtttagaaaaacaaatactgcatgtcctcattcctatggggaatcttaaaaaataaaagccacagaggttgagagcataataatagtggtttccaggggtacggggtgggggctcagaagattttggtcaaaggacacaaaatttcaattcaatagaaaaaataaattcaagaaatctattgtccaatatggtaactatagttgataactatgtattatattcttgaaaatttcaaaatattttaagaagttctcaccacaaatataagtacacgaggtgatgcagatattaattagcttgatttaaccattccacaatgtatacatatttcaaaacagcgtgatgtacactataaaaatatacagttttatttgtcaactaaaaacaagtcaaacaatacacacaaaaaataaaaaacttacagtctagaggaaagactgataagtaaaagactaaaaagtgtgattataatactatgaatatgtgcaatctgtatcgtaatgcaggatgctacaggactcttacgaagacatctagcccaatgaagcaggtatcaggggaggcttctcatccaactgcactatggaagatgaacagaggggtaggatttgacgctgcagagggatggaagttcatagagacccagcagttggagacaatgtagcacagctatagagagttaaaagctggaggaatggtgagccatgacgttggaaactctcgacgtgtattaagaactcgaacttcattctctcagattaaatgaggaaagctagcaaagagttttaaggaagaatataacatgatcacattcaccttttagaaagagttctacattcatggtgtagagaaagtggcaaggttgaactctgagaaacgtggtggctagaatctgggtaagaagtcctgtggacaatgggaagtagctgtgagaacagtggaggatatagaaatggtcaggaagaaaacccaacagacttggtggttcttcagacagtgttggatttaggttgcagtcagagctgtctctgtcctcctgttcctcagagctgaagtctttgctgatggtcacccagggagcccttaggtagttaattttagtggccagttctattttcaccatcagtctcttccccagagacacacaggatctctgccactggctcctgtcttaccatgctctcgtttttgttaaattctttcttccttagcaccaacttaatgcccttcaaaaatccatgtttaaaatgtatgctttttctacagaatgaaatacagtttactctgaactttcaggaaatcatggaaaaagagagtttgcacattttctttcccagaggaaatcatattaaagttaaaaaataagttattcattgatctattcaataaatatgtatttatttacttttattatttatttatttatctttagagatagaatctcactctgttgcccaggctatccttgaactctgaacttcaagtgatcctcctgcctcaatctcccaaaattctgggattacaggtgtgagctaccatatctagactcaataaatatttattaagtgtcttttatgcgccatgtaccatacatgatactggggcacagcagtgaacaaaacacagagagtctgtgtccatggagctcgttcttcagggaggaaaccgactctgtacatcacaaatactatacgtacacactgactacatatacacacatacatatagatagatgtgtcaacatatattaagtctgatggtgataagagggaaggcattgttacagtgtgccagggaaaaagcctcattatgaagacgacctttgagcaaagacctaaagaatataaaagaggaaacacagatatctgggagaaaagtagtctgcaagcaggatcaataagtggtgccttgcctggcatgtatgagacatggccagtagactgtaatagctggagcagagtgagcaagaggaagaagctgggagatgcattcatgacgcaccgggcaaggatggggtgggagggaagaagatcatacaaacttgcctcctcttttcattgacttgggaagccactggagtgtctgtgtagaggcctgataccatttgacttgagtattaacaggctcatcctcgtttctacttaaagaaaagattgtaggagggtaaggtagaagcaaaaagaccagttagcaagcttttgcatccagaagacgacgatgacttgggctggagttatgcagtggaggtggtgagcagttgtcatgttctggttatgttttgatgaaatgtctacagattttgctgaaagaaccagggtgggtgccggcgacgtcaaggatgattcccaggtttggtgctgcagtttgcttagagaagtcttagacaagccttttagacgagtctgctggggccatcctcaattcctccaaatacgctttctcaccctttgactgctggctctcctgctagccattttctccttttaagatgaggatatttaataatcactctcttgattctctacccatcttcttccaaaaatcaaccatccagtttccaaatgtgtaaaatgtgtgggaaaatcaagctattttcaaaagtgctgtaagtgattacaacctaaaaggataaatgttggtgttttgtctacacagcctctctttctccctccagaactaattgtcaatgtagacagcagaatgaggattagctgggctccagaagagttcatcatgttctgtgggaataatctaatttacccacatttgtgaaaagtacctttattagatttgtcatattgtgccattgaattaaagaccaactaacatttgactctcagcagaaagctatggagactaagcatcactagactacccaggggaagccactaggcaaccaagaccacagaggacttcctccagcaaaagggcaatgacccattcctttgcatgagggatgttgggatgttctaataaatgtatttggcctgaaaccttcttctcacattcaaggacaattagaaacattttaaagagaaggttgaaatagcaggaggcaaaatagtaagtcatgtaaaaaaacaaaccataaaagatacctgaattaatgtacttgagaatgaggaaggcttctccttctatttggctaaagtgaaattgttgcccttcttggccattcattcagccaaagcataatccttaaaccaagtaaaagagagaattgcatcatcttgcctttgggcacaaatcccttgaaactctgagtagatgcctgaggtgtttaagaatgtatcaaaaccttcaggtaaaggaataacactctgattacagggtgtaggcatcaactagtaaggaagacatgttggaggataccaataaatgttcaggacatttaacattttcctttgcctttactctggttgtgatgttttgctcacggccactgaacattcatcgaccttcccactggctttggtcaaaatatccccaatgatattctctatcatttcctgaatctttcacttaatgaaaagattttcatccctgctctttttaaaaaaaaaattgtggccttattatcaattggaatagatactcatcctctgacattttacgagtttaagattgtcattagttatataattatcttatgtattttaatttatttacattactatgacatgtgtttttgtcctccatgtagaactacaaactctttatatctagggataatatctagttggtaaaatgcgccaaaacttttaggtagtgttatgcagacgtctatattaattgagaacattaattataaaaattgtaaaagcaaaagcggaatgagtttccaagtgtaaaattatgattcagatttagtttctataaatggaatcataccaatacagcaatattttgtttcaactaaaatctcttaagtaacaaacatttaaaattagctataattatttaagcagtcaaaacaaacagggaagccaaaaattccatatcaggatgttatgaatttacccattctgacattactatacaggagctgtatttaaaattacctctaagaaattcatgatgcaatttcaaaatggaaaataaaaaaagactaccacattttgtcaacagcactctaaagaggtcctgatgcagatacctgtgaattattgtgaaattctattatctcatagaaggggcttaaggaaaaaaaaaaaaaaaacagtgtacttcagttggcatttgcaaagctctctaacacaactattccttagcattataaaaaaaactctaagccatgtcttctcttgttagcttgtattcattacagaagagaaagcagtgataacataatatagaactggcattctccaaatgactttaatccatcttcccaaagactagttctcattaatttcaataaccagagtcacaaccagaaaatcaacaaccacaacaaaaatggataaacaagtgacttaaatgatgtgttctgaaccctgtaaaatgcaaaactgaaagatacaaaacatgaaaatggggccaacactcggcatgaaaatagacgcgtacattcccatgccttgacaaagtataatattccaaactcaaattaatgggtcatctctaaagagtactttggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggagacagagtgagactccgtctcaaaaaaaagaaaaaaagagtactttggtaactcatttaataatttgaatgaaccaatttttctacacaatcacttgctttggttctttcatccagcttccacaaccatccgtctaacaaagccaagaaacctggagtgttccttgatatctttctatctctccacttcacaactaattcctcagcacattttgtctactctaccttcaaatattttagagctacttacatgaccaccattgctatcaccttggtccaagcttccgtcatcttttatctggatggctgcaaaagcttcatggtctctctgttccatccttgttttccttcagcctattgtcaactctgcagcctttcaaaatctgaggattgaactctgaccgttttttttcttcttgcccagatttctttctaagagggctggggaattatgtcttacaaaccatagtatctcattaagtgttgggtttttttttaaaattaacccaatataacttggcttactttccaacctgactctggtatagcattaaatgacagatagtagacccccttaccttaaacattcctttctactgatgtctcaagtctttagacaaagcttagctctgacaaccaactgccaacgaaagaagctctaaaacccactgacaacttgtaaggccgtgcttcaacatgctttgcctattcaggctgaaccaatgtatacctttcatgtatcgatttatgattttacctgcatttgcaatctccctagaatgtataaaactaaactgtaagccaactgccgcgggcacactttcttgtgctctcttgaaactgtttccacaggtcacagtcactcattgactcagaataaacttctttaaatattttggcagaatttggagttttcattattaaatctaaggcaattggtcatttatttcttcaaaattatgaaactgaagaaatagtgtcccattttgcttaaagtaaaagccaaaatctctatatccttgaaggccctataagattagtctctcttaatctccgagttcatctcctaattctctacttttctctcttgtaactggcctttttttttctcataaattatatctcatctgaagcctttgctcaaggcacctctcatcctggaatgtgcttttctcatattcagaaggtgaagtccctcataattgctaaatgtttacttaatcctatcttcctactgaggcttgccctatttaaaatggaacttcccacacatttcctaacctctaactctgtttctttatttttcttttgcactcatgattttttaacatactctattgtaattattcttgccctactagaatatcaactccattttggtaagatgttttggtctattttgggtcacagtcatatgccccagcacaaaaaactagttactggtaaatatttgttcaaagaaattcaatgaataacagaataaattactattctttctttcatttagcttccttactaacaagacattttttattccatactttcttttccttttataatagagattcagggagaaaccttgtgtgaactactcattaaaatgattagcgttatctgctaatcatttcaggacagagcacacaattaaggtcggttctggcatggagaaataaatactattataacactaatacaaattatacattgtcaaaggaagcaagttgttgaggcaatcacagaaggaaaagaataaaaaccccagcaacaggacgactttaaagatgtatttccagataacttgtattccctcatgatcagcacaagcgaaatgcactgatggagcagagcctccttgtccaggtgtgaattttctcataaacgtggtagatggagtgctttgttaagtgaaataattgtgatactccttactacaaaaagcaaaactgtcagaaatggctccccaaacccttattaatactgattttcaatgcctcctactatcacaagttttggactttattctttaagtgaaaagttcccccacaactcccagcagttatcatttgactgtccctgaaattatcttaggaaatatcattgaccaaatttgaaacagagcaaagttaaacaacggacattaacaaggagtataattggccttagcatttaccacctttcctctgccccctttgtgcaatacacgctctacatacttttttgatcagtaaaattcacttctatttagactaaagctaagtttttctctttctctttccttttttcccccacctcctatgtgtatgtgctggtgggggagggggaggaaggaagagctgagctacaaaattaatcagctccaggtatgtgccaggcattgtacttaatccaagttcattgaatctgaaaacaatcctaaaatgaagattccctcaccccaaatccctcaactggtaaatgctagagaaataacttggtctaagtttagcaatttaaatttttatattatttttctaaatcaatttattgtccctgttataaacaatgggagtgatgtcaaacaattttctggttaattattaagagaataaacagtggaataaacagtgagtaaggcaatatttaacaatggaagacataggccatttcctaatttgatttccagaacaataaaactgatttcactaatttctctgacaatgtattatcctggggagttaataacttatttttattaaggtgagaataaatgtactcaggtacacaggtggcagaaaaagctcatatatccaattacctgcataatgaaaccaatcacttaacttcttctttggctgttggaaagtcagaggtgctaaaaccaaattttctcagtcccttaagatggactgaaaatcctcaagcaaaaatcactctaccttatatatggaggaaaatctgaagacaaaggaataaggcatcttaagttctactccaggaagtttgtttaagttgctgtcttgaaaaccaagcctctgatattttcttagctgtattaaattgtagctaaaaataaatggctatttagcatgtgtttactatccaaggtccatagagcaagcaaaagggcaggctactgcttttaaaacccatgtagggattaattaacagaagggcactagctagcaagttatgctaaatgacaagtcttgattaaaagctaaaaacaatgcttatttcaaacctaacttcctggtctatagttactctcaactttaaatgcaatttgctaatttcaactccaaatacatatatatgcccttggggttaagaagtgcttcggtcatgcctgtaatcccagcacttttggaggccgaggcgggtggatcacaaggtcaggagatagagaccatcctggctaaccaggatagagacggtgaaaccccgtctctactaaaaatacaaaatattagccgggcgtggtggcgggcgcatgtagtcccagctactcgggaggctgaggcaggagactggcgtgaacccgggaggcggagcttgcagtgagccgagatcgagccactgcactccatcctgggcgacagagagagactccgtctcaaaaaaaaagaagtgcttccgaccttattttatcaaagcctttcattttccaaatgagaatttaaggtattttctcaagaaaatttttatgaaacaacaaaaaacccgatgtttttaatctcagaatctgaagatcacctatgctagaaccgctatacagtagacaaagaattagttttttctttcctcatattctgtatttcaggcccaaataatctacccaatttagaaggggaaagatgttcatttttcttaatgtgtgatggaatttcaatatgtacaatcataacttctttgaagatgggctggcacacatagaactgtgcattaggcttttaaaactttccaggattacgtagagtgagtaaaggcgattgacacaggaggcagtctgatgatgtggagtgaattgggaatcacagcattccccacaaactgctcagctgatctttctgtattacctggaagctcctctatgagcctggcttgtagcatttgaggtcaagaaaccagtcattaggacgtaaatttgtcatttgtcagaggaacacagagatccaaaaataatcctgccataatgtagttcattagattagctggtttgggaaataggtcacaggactgatataagttgatgggactggggttaggaaaggtctttgtgtaattcgcaaaattatatactttgatgatccctaaagtgtgaagatctatgcaacctgaagtagcaggcagactgaagtcaagtcagtgaagcatcagggaaggaagaaaagagaagagctgctacaatttaagggtttcctagcaatgggacctggggcaagattcctcatgtgtaccttgcccagaaatagtaaaaaatagactgtaatttcttttttttttttttttttttttgagacagattcttgctctgtcacccaggctggagtgtagtggcgtgatctcggctcattgcaagctctgcctctctggttcccgtcattctcctgcctcagcctccctagtagctgggactacaggcacctgccaccatgcctggcttttttttttttttttttttttgtatttttagtagagtcgggatttcactgtgttagccaggatggtctcgatctcctgacctcgtgatctatccacctcggcctcccaaagtgctgggattacaggcgtgagccaccgcgcccagcccagactgtaattcttaacacagagcctagcacaaagcaggtgacatgcaaaaatagtattagatgttgtctaaattagctttaccaactctgtgccttctctgtgtcagataatacactttttacatttcaactcatttaatacaacaaccatcttacagttaggaaatgaaaattccagaaataagtatagaagatgatatgtatgcagatgtttgcctgattgtaaagctcatggcttttctacttctctatatgtatgtaaaaataattttgagaatgacttatggtggttacttaactttgcatcagttctgtcatttaatattcatatctatcttatgaatttgaaattattatcttatgtaacaggaactacaaccagaaaggttaagtgccaaaatcatactttttagtaagtgggttagtttcctgttcgggttcgtttctctatgatacacaattgagacataggtactcaactgtcaacctgcaatcagtcagagactaagttgctcctgaaattttgtcactttagaaatgctgtagtttaatgaaggccactttaaaaacaatcactgccaagttgggaaaagtaataaaaatggtaactgtgctaagcagagagaattacttattttatattaatgaaaatgaatcttaaagtgtggcacacatcacatgtaacatgtattttttaaaagttcatgttacaatgtaccatttgcataacttagaaatttaatgtaattaagtacaccaaatgcagtgttattttattcatcaagatatggagtaatatttaggtcaaaaataccacattttcaagctttatggtaaaagatacttcactgcaatattttctaactgagaaatcaaagtcaatccataaggtatttgacatatacaattgaaatatacaaatatgtattaaactggaaaaatatatagatttaaaattctataatctaacatttagacatatatatctaatctaataatttttcaaatttgggtactttatattaaattaaaagagacacatgtttgtgtcatacaaactcatatcatagcaaatattatagaaaatgcttgccgtaggtcagatacaaagatgagtacattatacataaagttcttcatctaatcctgaaagttaccgtataaagtaggtacattcttgatccacatattgtagcttaggaaactaaaacacctaaccagaatttggagccaagctgtcaagatttcaaagattgtgcttctgtaaaaggaaagtcaaatcctttctggttcaactttacctgttgaaaatacttctaaaacccagttttctgccatcatagatacagaattcagaatacaatcttaatttcccactggaatgttccagagtgtagggaaaactaagaaccaaggtaatctattttaaatatttgtttgcattcatttgagtctagcgtatattttatgatcacaacacagccagactgtgttctgttaccaattgtttccattctctgaggtcaaggagaaattgtttagctcctatgtaaaaagggtagaaaatgtctagaaatgtattacattctatccagaagagggcactggcaggtattcaacccaatatctgatatttcaaacagagggaagcaaagctccaatgtaacaagtatcttttcagtaagatgggcttccattcatgccctgcagtgtgactataagaagcactaatatacctggataaaatcatgttttggaaactgatgctagtatttttagcagttagctaattttaacagctggcataagattgcacttttagttgatattactgcctaaacgttccacatttttcctaagttttactttcaaggaagtttacattatttagcattcagttatgaaagttctgtcaaccattacacaatgtacgtaagggggctatgaatcaaatgtgcctcatgatattgactttttgagcacaattctgtttcatcaaaacttacaagacatagaaattgaaaagaatcatggttttgatgtctgatttcctgagtggctgagacaagtggtttatcaatcatataatttctgcagatcattttaattagttttctcttacaagcagttcttttctgcactgtgtagctatgaaagtactctttattttgtgtccaaggtttatacttagaaactctctgggaacaactgtcattgtcaggccttgtctttgttattcttgtgttgtgaaattccatttgccatatctgaagcttaaatggcaacagaccctgttgaataattgtcttctagtgttagatgattagctttatatgtgcaaaatggctttttagaaaaactacctagataaaaaggtcaaaatcaaaatggaccaatttgaaaattatcattgcaacaaaaatttgttgtggacacatactcattgaatatatacaacgtatatttactgagactataatatgtgtcagccatttctattacaggcttattgaatttttcaagtaatcgatggcaattaatttgtcacataattgtactacttgcaaaaataatctcctaaaattaatgactttgtctcctgtgctactattcgaaggcagagtggaaatggcttttaggttatagaaaagaggcagagtgagttctctcactagctgtgtcttaggtaagttccaggtctctgcagtcaatcgccatatctataaaatgaagatgatattactacctggaaatgttgtgtttacaacctttatcagagtagtttactgctgtagaagctcgaccactggtaaccattgtgtttaagtttaattttcactaaaagcccaggctctgactgtaatggtcactcagagttgtgccactgaaagggcacagatggcagtggtcaagtaggccacgtcctctgcgtgcctttttcgctttcagaagtagggctacgaagctgaggacagccagaatgactgctgagattcacatttccattaatgcctgtccattccaaaaaaagatcagtgtatgccaacggcgagatgccttcctcaatgaagtcagaatctaacagcgatgagatcctttgtgtttacaagccttgaagctgagatcagatggcattgccattgagtcggctaggagccagtagtctaaagtctaagtatatattatactgtctgaatcaacttagtggctctcagttctatcatatttgaaactcatttttataataaatatttgttaatgtctcttttgctattccaaaatgaaattgctaactccctctaagaataatcttaaatcaatgtaatatgttaatagtgacataaaagacaatagtaagagattaacacatacaaatagagtactaatagtataatatgcaaatgcttaggtacaattataccagatgatgtggttataatgggtaactctggatttaggaagtgtaaaacaatagccaaatgtgccagttatttactctttgtctctcggttctaaacttgcacttctatgctctgctttatgctgctggggctgagaccctgcaaactacattctgcttgccaagattctctctgttaggatctgccactaggagcaccagagacttcaaagctggatgaggtggaagaaacttgccccttcctgtgtccctctaggggagctccttggctgcttgtggatcttgtgagcatcactctacgatgcttcagtcaccccccaccaacagcagagcctccttgtggcagcagctgaatacagtttgcaattttgttcaacacttggagaaccaggttaattgtctccttcttccctcaaataccagccggccattggtcctcctcagaggtctggattccagcttcatgagtctttcctctgagctcagagatactagcaccagccgagccacgccttgcttacaggtctgagtttgagtttcactagaccttccctcgaagttttttgttttcctttttttccccacaattctgggggtgggaagcagctgcttcctgaagttgctacttccacaataccttagagtttctttttctaccctttaagttaccagctgacaactttttactaattaagaagtgtttgtattaaatcttctctgttcaaatagctggtatcatttctgcctccagagtggactctgaccactacctctactgaatattgtcaacattatttctttcctgagatgaacattttattggacatttgaaataaggcctggtgataagtttatatatatgcataaaatcataataaatgcaacagctactggtactgactgatgtggggatgacacattggtggctgggaagccactagcagcattgccattgctaggttcaaaaatgatgaacaactcttgatctcttgatgatgtactagacagaaactacaatctgccctgatttgtagtgcagttccattcctgggaaagttagcacacactaaaatgggggaaaatacactttgtgtttttatgtaaaatatagccatgccatacaagatatgaaaatattcattgttcaggacagtcttatgcattgctgtttgtctaaaaactctcactcttacccactaagtgccattgcacttatcccaattacgggtgaccaaaactgtgcccacatcatgtcttagagtaatgtcatatctgttcagaataaaataaggcagaggcagaagaggccatttcctttatgaatttagttgaggataagtcatcccatgggtcttccacactgaaagggcatctcctcatgcttctttccacttggcaaaagtctcaaagtctaagttataatgaagatagtttttatgaaaaggataatatcctaaaagaaattcttagcccctataaacacattttacaatcaatatatgttaattttaacatgaaagaaataaaactagtacaggtaataacaatagtaatatttgtgcataatcatattataatacataaatgcctaggcacaactacattagatacacagggtgaacacaattatcagtctagttaccctggagcaccctaacacaagacaccagagcggcctttaaggtttgagaagaaaagggaaaaagacagaaaatgattctaaaaatcaataaaaatgttatacagcaaaggttttatgaagaagaaggcagcatgaagcataaggttaggattagagggccctcaagattaagctgaagttaggggagaaagtacacatgcgtggttgatatacatgtgtatttttattcgggaaacctgttggtgtggacacatatatatacagacaacccttgaacaacacggtttgaactgtacacatctatttctatgtagaatgttttcaataaatgtattagaaaaatttgtggagatttgtgaaaatttgcaaaaacatgcagagaaaccatgtggcttagaaatatattaaaaaaaattcttaggtgtgccatgaatacataaaatatatgtcaatacaagcctatttgatgatttgctaccataaaatttacacaaatctattgtaaaaaggtaaattgtatcaaaatttatgtatatacttactgaccaaacatggcatcactgcagttgagagaattataaacacacataaagatgcagtattaaattataactgcacaaaattaactgtagcacatactatactactataatttcatagccacctcctgttgctattgtagtgagctcaagtgtcaaaagtatccacttaaaatgccatgtaatgctaatcatctctgcatgagcaggtcataaccctggtaaattacatatcacaataaaaagtgatctctcatgtttctggtgtatttttttaaacatgttttaatgcaatagcataaaccttgaataacatatgagacccatacaaactgccactagtgatgctggaaatgctcttaagaagcagagaaaagtcatgacattacaagaaacagttaaattgcttggtatgtattacagattgaggtctgcagctgtggtttcatttcaagataaatgaatcctgtgtaaggatcattgtttaaaaaaaaaaaaaaaggaaggagagaggagaggagataagactcatgaagccactgctgcagctatgccagcaggcatgaacatcttggactttttgcaaaatacctttttatcttgaattgaaaatgcagcttttatgtagatacagaattgctataagaaaggcatatctataaactctaatatgattcaagaaaaagcaaagtcatggtatgacaacttaataaaggaaggtgaaggatctaaagctaaaaaaggaaggagaggagaggagagaagactcatgaagccactgctgcagctatgccagcaggcatgaacatcttggactttttgcaaaatacctttttatcttgaattgaaaatgcagcttttatgtagatacagaattgctataagaaaggcatatttataaactctaatatgattcaagaaaaagcaaagtcatggtatgacaacttaataaaggaaggtgaaggatctaaagctgaagaacttaataccagcaaaggatggtttgataattttaggaagagatttgttttaaaaatatgaagataacaagagaagctgtatctgccaaacaagaagcagcagatgatttcccagacaccattaagaaaatcactgagaaaaaatgggtatctacctgaacaggtttttaatgcagacaaaagtgctctattctggagggggcagggaatccacaaaggacatttcttagtaatgaagataagcaagcactaggatacaaggaaggaagggataggttacccctactgttttgcacaaatgcaattggatttatgattaggactgccctttttatacagctgctaactcccaagccttgaagggaaaaggtaaacagcagctgccagtcttttggctgtacaagaagaagagctggacaatgagaaccctttttctggattgattccatcagtgactttgtccctgaagtcaggaagtacctcatcaataagggactgcctttttaaagttcttttaataccggacaatgctccggccacctagaaccccatagttcaacaatgaacacattgaagcagtctactcacccccaaacacaatgtccctaattcagcctttaagtcagggggtcctaaggatttttcagactcattatgcatggtactttatggaaggggttatcaacactatggaagagagctcaaatagagaaacatcatgaaagcctggaaggatcataccattggagataccgtcattgttatagaaaatgccctgaaagccatcgatccagaaaccataaattcctgccggaggaaactgtgtccagatgttgtgcataacttcacaggaattatgacagaatctatcaaggaaattatttaaaatattgtggatattggggaaaaaaagtcaggatgaagggtttctgaaatggatcttggaaaaattcaagagctaatggaccgccagagtagagaaattaacagaagatgacttgatggagacgactgcttctgaatccgtgccagacagtcatcagtttggcagaagggttccaattatccgagattccttttgacttcttttacgacataggcccctctatgagacaggaggcccatgaaaacaaagcaaatggtgaaagaaggattggtacttacagaaacatttttagagaaatgaaaaagcaaaaagttatacagaaattacaatgtattttcataaagttgcactaaatgtgcctgcctctcctgccttcttttccacttcttccacctctccatctctgtcacctataagacagcaagaccagcccctcctcattctcctcccccttagcctactcaatgtgaagacaccaggatgaagacctttatgatgatccacttccacttaatgaagagcaagtatgttttctattcttataattttcttaatagcattttcttttctctatcttaccttacagtaagactacagtatacaaaacatatacaaaatatgagttaatcaactgttgatattaacagtaagccttctcaatcaacagttagtagttaaggttttggagagtcaaaagttatatatgaattttctactgtgagtgggtcagcaccccaaaccttcatgttgttcatcaatcaactgtacatatttaaatacaatttgtgtgtgtgtgtgtgtgtgtgtgtatatatatatatataatatatttctttatttgacataaagaggacattgttttgtatcttattcaaagttattagagttgggatacattgccttatatatacagtatatcaaagaaaagttattaggttaaaatagaaataatgaccttttagcaaaggtcactcaataaatatctgtacaattaggaatgaacaataagttatagagtgaggagagtgaactaaaaagaaacaaaattataaatgctgatgatgctgatgtccagatgatgagcagaattaactagtggtgaagctctaatctcatttactcattagaattgaggactagtcctccttgaaaaatggtgaccaatgtcctggtatgccaaggacagtctgacttatgcctgttgtcctggtctttattaatactttactctttaattaaaaaaaaaacacaccactaatttggataatggttaagaaaacttaggaaaactgataagaacaagtaacattcactgaaaacttaatatgcgctatgatgatattttcatgtttttatatgtgattgtatttacttattgtaacaaccaagaaaggcgattatatttaccctgttttacatcttaggattcccagagactcagagagggtacttgaatttttcaagcacgtgcagtttccaactgtcagaggcaggatttcaacccacagctatcagatttcaagctgccattaaacatgcctgggatatcccttctgagaggagagtaggcacaaaatacaactaaccaggaaacagattccttatgcagtcaggaagaaaaagaaactgggccatatataagctaggaccttgcttgaacaatgggaaatttaaaaaataagaagaagaaattatccacaagacatgttttcagccagactaatttatgaccactgtcagccactgtaattgcctatttgtacatagtctgtactcatataaattcccatacttgcaatgaaataactgtctgcttcaggcaaatgactggaggacttttttttttttttaagcactgtagtgtggggtcataagaaaacacaaaaacaaaaacctatattcttgaaaaaatccctcccaggtagaactaaaaaatcctaggtggttatcacaagatgcctaagacaaactttcatcacttcacaattttgactatgttaaaactctaattggttagcatgttgctttcaaaatatattcatgtgcctcctattctaaaatgacttaaggcttttagagcagaaagatccagaattcaacattttcccaaatttccagaaagggcagtacttataaaagcatttggtcagagacagcgttagaaatatactatcccttggtgaagctgtctgggacaaatagttttccaatatgcttttagacaaatttatggtttaatgaagtattttgcctacttgatcacagtaacaaatcagacatatttatcaccttcccttttaacaggcagcaattctgtctcccaagtagacttggctgacactttgccatattcttcatggtccaagtgattaaagagtccaaaatcttagactgacgcagtaacactcagacgcacaaaagtaactttggagctgagggccaaactggggacacaaaaaccctctggtgggtataagatgactgaacgagtttgtcatttttccattttcaaattgccaacctcgcccccttcacacacaggaaaattgtatttttcccagagcacatctgtcagacaatactctgaggagtgtttgaagccactctgtgtaaacagagcagagacgatcagaaaataacaactgccacgtgtgtaaagctccctgctgatatctgtgagagcacatgggtgtcaaaaccatgagctaagagccctgctcccattcgtcaccatcagcagtcaacccgagaaaaactgctgagcctcagcccaagtctggagacctgctgctcactggaatgcactagggctcaccatgcagcccaaatggcctcatcacagtcatgtgtggctttccctcttcaggtgtagactgagtcccatctccagcattacctgtacacctgtgattggacctgccctaattctgcacatttgatgaaactgtctcaagacccccaccagccagttctgcatatcaccatcagcaacaagagtttcctttctacctccagcaccctgcatctatgcagaaaacagacaatctgtcagtagtttgcttttttatttagcactccatttctagaaagtcgtgtccctagatatttataatcagaatgatgatttagctgatatacccaggtgtaatacctagacgatctcttaagatttgtatcttacaaaggatctatcatttttttgtgagtaaaatataagtatcaacttttttattattcatatactttttatgtttttatgctaaggcagtgtgtgacagtttaaggaagatgttctatttacagctattaataatttactcttgcaacttttgttaaaatatttatacaaataagttgtgcatgataattgccttgattacatttagatactgagctgtgaaataagcaagcatttgttcagaaagcaggagaggttaaaatgttattagaaatggctgagactagaggaggtcagaactgggatgaactaagtcctgaggtctgtgtgctttgggtgtgcccctactccttcattttggagaggacctatcaggggacattgactagtgcgcttttaggacagaaaaggctcccctgcaaccaggtaacctccaatgggcctgttgcctaaaatgattttaactagaggtaaagtcttttatattaaacttagacttcaaaatgtaaacaccccaagaagagaaaacagattgacttgaatctaccttaagatgtaaaggacagaaaactattttctctcagttttcctagaagtgggaaggaaactatagactgccatatgtgaagcaggcaggaaggaagcctctagaaaaagaaaaggatataacagtgaggggcagggctctggagggggccacctcacagctttgccaagggggagggtcattcccgtttcctcctgctccccatcccttctcagctgagggtcttctccaattgaccatacaccatatttatatgggcctaaaagtcatagtttttcagggagaagaatggacacagagagaagataaatggatggaaaaaggcaagcaatgcatattttacaagggccaaaattagtggaaagaggacagaaataacagagtgcttgcaaaatggggtatttacgtgcagagaaacagcgtgctcttgcaccgctaagcactgttctttaaacgtctctctgcatcccactttctaaaatcctcaaccaactgcctcttaaccacacaagggttcttagagccagattgtcaatgataaaaacaaaataggaccaatttattaagcatccattattgagcagacactgcacaaggaagtttatgcagttatatcacctaattcttataaccatctgctggccccattttttttttcagttcaaaaaaggctcaaagtcatataataagcaactagcaagtaggaatttaaacccaacttgccctggctccaaagcccaagctctctccaattcattataaatacctcaaaaacatctcttatttgttaataagatgcactatttattattaaattatttgttaataaatgcatgtgtatattagtatttatttaataaaattcttaataattatttgtcagtaatattaataaaataataatgactatgatatatagttaggtttagtagggccctagcaatgggatatttgatattcaggtacattcagggtaattcttttccctggaatatttattcacagctatggatttatttaggtgtggaggagtcttctgaagaaagcaaaaattagactcatgtcttaaattgaggcttagacaactatagacatgcttgatgaattgggatgaggctaggagaagataaaagctaggtttttcttattccatgaaagacaattcatcatgagacaaaagtacggtatgatgcctggatgcagttccagggtctaagaatcaaatcaaatgatatattcaggtggaaaatgacaaatgccttgaaaccctcgagacctagccatgaaagcagaatatatattccaagagtcaaagaaaaattatatatgcaaaccaaaaaagctgcctttcaagatctgcagattgggttccaagcaatgctgctgtggaaccctccctacaagagcataccacaaggagagagccatttccttcccaaccttcagcaaaatgccacgccctcctagcaataccagacaaggagttaattgcttgaggctgacctgcaatagcagcagattcctggctttgcagaacagaaggaggtgcttccggaccgcttgtccagccagcatgtcaggtgcacagacaaggcttgtcagtagtaacagtgatatcagtgaccaatgatcagaactatctgtctgagcactagtaacaagctgcttgctacttggggatactttgttgagactgggcaagacacaagttggttcttggaagcagaatgatttagcctcctgttgagagcaagctcatttgtgcatacacagcatgggagccactatactggataccttacacacattcatttgttacattctgcaacaatttgttaagaacagtacattattcatatcttaaagataaataacctgaagcttaaaaaggtaaagtgaggctgggcacggtggctcacgcctgtaatcccaacactttgggaggctgagacgggcagatcacctgaggtcaggagtttgagatcagcctggccaacatggtgaaactctgtctttacaaaaatacaaaaattagccaggcatgatggtgggtgcctgtaatcccagttacttgggaggctgaggcggaagatttgctggaacccgggaggcggaggttgcagtgagctgagatcacaccattgtactccagcctgggtgacagagcgagactccgtctcccgcaaccccaggaaaaaaaaaaaaaaggtaaagtgacttgccccaaatcacacagctttagtgttcacattctttctactatatcctgtgctttttcatgaccctttacttatctcctcatattcctcagactaagtcccagatattctagcaatgaccttttattcagaaaaattgttatttgggaacattatgaaatatttcataaatttaactatttacagttacatacatacctgggccttcccctataattattttgtaattcaacagaatatgatatagtaaccagagaatttcctttgaatgtagagaaacccaaaggtaaagatgagcaagcagataattcatgggtatacctcacaaaaagagatgtcagccaaatttatcatttatgtcctttttaattgtctgctggacataattatggtacaacttttaaaaggcaataaagtgtacccattctttatctcaaatacactttgcattcatcccaaagcaaagtgcagttccaaagagtctaaaaacttgtagagaagagtcaggtgtacaacatatactcttaggagtactaatgaatgctcaacattctatcagttccccccaactttttttttttctttgagatggagtctcactttattgcccaggctggagtacagtggcatgatcttggctcactgcaacatccacctcccaggttcaagcgattcccctgcctcagcttcctgagtagctggaattacagatgcacgccaccacaccattaatttttgcatttttagtagagatggggtttcactatgttggccgggctggtcttgaactcctgacctcaggtgatccacctgtctcggcctcccaaagtgctgggattacaggcgtgagccaccacacccagcctagttttcctttatgaactacaccctgcaagagaaggaagttgcctaatacttatcctactcagcattccttcaaggaacaaaagacaaactctaatgaaaactgatccaatacagttggtatgagtgattaactttgcacaaatgatcatatatgtatcaggcattttccaagtgctctcagctaaaccattttaagagagctctaacccagtagtagcaagaacaaggtgtaagaagaaatggcaatgaaaggcagtttcttgtcgaaagtcaccaagaaatcatgagtttagaagtgggttccttaccattctggatggttcttgacttgatgggtaataaactgcctgtggtagtccaacaagcaatggcaatgtaagtcagaaaaatggaagtgctgtttttggagaattgtattgccagcttaatacagaaagtagaaaagctcatgatgcttatttgttgtaaccagcagagttggggagtaggagcttttgcccaacctcctcatcagggaaaagcttgaggggcagaaggccactattttaccaatgacttgatcagcactgaacatccatcaagactccatggtgccctgccctgccactgaatatcacaataattcagacaagtcagtgggtgacagaatctcccatgtaactcaaataccactactgatagtttgaatatgtattcataaactttcatatgcatttttcatggtatccttctaaccttctgtgtaactaaaacaggtatgattccattttgcagatagggtaactgatggtcaaagagtaacacaaaagcacaaaagtaacttacattcaagtaaaggactctgtctctttaaaatctcaaatacagcaacctttctccccgcagtatactcagggattcttgggccagcttccaagcctgcaaatcctcgttctagtacacggccaggaggaaagaattccagggaaagatctaaattacaagagaatctgtgacatctgcctggcaaaatattatttcttcaaaaagtccattttttcagaaatgacattgaaggtctaacaacttgccatccttcaaaacctgatgaaatttgctgagggagagagagaaaaacaagaggtgaggacagaaagaataagtaaaggttcctgattaaactctgtagaacaaccaagtaggagaatgaataccaatggtaagtcacaggctcacaggctaaaagtaaaagctgcccaggaagaaagagaaagttctggaagcaaagaaatctcaagtttctcagtgggtaatgaaaataactgtgtcattttagatcacacaccttacagaatagaaagaaaaaaacttatcttaagatacactcaagttttttgactattttcctgaaaccaaggcgatggtactctgatactctgctaggatataaataagattttgttttttatgaactgagcccctgattttttttgtctaatggtacagtgcacctcaggttataagtaaaattatattcctattcttttccagatgttattttcctcgtattaacaagccattgatgtttacaggaataaccagcaaaaatgaagcaacatcacatgtaacttgctacaaatgcaaagcatcaaagcccaacaagatctcctcaataataatgtgcattttaacaaggtctccaggcagtctatttgcacactgagtagcactgttttagaggtcctttacctgagcaggttttattttaggtcctggccccaccctgctttggactctttctcccgttctctgccatagagtaatgcagaagtcactgaccatcaagaaatccaggatgataagcgccagagggtccttcttcattatcaaaacctggggacattggccatggtcatccaccaggttagttgcagaggctgaggctcagtcttatttctccaacttcctgcttcagggaccttctcacttcccactgtgtttttgctgtttgccatccctgcaatgccccttccctcacttacgcactccctaaaaaaggatatcgagcaggcgtgacctaagtcaaaactgtcaagtagtacatttatcttcagtaaccccgaggactaaggatccttttggttctgttctttcccctaaaccagccatcagcaccagtactgtcattatactcaccaacttgtactgaagttgcaaagaagttttgataacaataacagtaatagcaaccaacatctattaaacatgcatgacttgccaggcactgtgctaagcaccttgcccattcatttctgacaatatcttcagaacaatgacccaccataacacaaaattctatcattaattcattttgtacataagaacactggaggtagaaaaccacagtataacttgccataggtcacacaattagtggcatttatttacttatcttccgctataaataatcaatgatttaagaactctcactgccaaaggtatttgcattctacaaggcacagtgtctcttgcctgtaatcccaaaaccttggaaggctgagacaggtggatcactggagcccaggagttggagaccagcctgggtaacatggcaaaacctcatctctacaaaaaatacacacacacacacaaattacccaggcatggtggtgcatgcctgtagtcccagctactctggaggctaaggtaggaggatcacttgagccttataggtaaaggctgcagtgagctgtgatcttgccactgcactccagcctggacaacagaacgagaccctatctaaaaacaaaacaaaacaaaaagtcttaggagaagaggagctacctggtaaaatttcagcagccactggcatgaaggttttcctttgcccctgaaatcaccatccttgcagtagtgccctatgtacaaagacataggggtatttagagattaaattaagaataaaacacatttccagaatccagattacgctgtagcaaggactgtgtccagaaaccaaatccaggatacacagcaaaatatgacttatgcaaaggaaaatatcaattttctaatgtaaggaggttctgctccaaccaaacacttgccccactattgtgatggagaggacatttactaaaaaacagaaaaatgaggctagttggctcttttcttaatgtcagtaaactaatgattgtgttctgaaggcagtgtattatgatctgctgatggaggttagagtttcacattgtgactgaaagtatttttccattgtttcaggcaaaaatccttatttttttaagagaaaagaagaaaactgctgccagtattaagtaggtctagagaaataattaggcatttttccctgattatttaattgaccatggttgacctctatcggtgacaattatatttttttcatgaggaaacactgacctattttattccatttgccttccaatatttgaaaaaatgggggaaaaatctagcttgaatgtaaatgtttataaatccctaatcatggaaattcggaggcatctctgggcatttttatcactgataatcattaccttcaatggagagttttctgcattattggagagtagatttctaaaagcgtgaaatattacaatgttaaatatagctaagtgggacatgaaaactgtttcatttattttgttattccaatagggcttagctgacacactgttcttgtaatatagtcagtgattcagaaccagtagcttattaagcggaaaaaattaaataggaactgcctgtcattttgtaaactcaattttcagagcatttcagcacattcaaccaatgagttaggtaatcagaatctcaggagatattggattcaatgcataatgtgtttgttttaaattatcaatggcattatctattaattattatcaattgccaacatacatttcaacatattgcaatcaatattttgcatacttaataaatatttatgaaagatggtggtggattacagactgtaataaatatatcattgattacagggtttccacctatagcatttacattcaaaaagatcaacatatttttacattggaccacagaaaggagatctaagatggttcagctagaaaaaatattattcccagataaacatatttattttataaaataaaatttagtttgaatatttttatgtgcagtaagtcaatgtagtgctgagtgattgctactaaggtatccacactaatttgcatgtactttgctttaaatataaaagatgtaacagtaattcactcttactaactgaaaagccttggccaggcgcagtgcctcacgcctgtaatcccagcattttgggaggccgaggtgggtgaatcacttgaggtcaggagttcgagaccagcctggctaacatggtgaaaccctgcctctactaaaaatacaaaataaattagccaggcacggtggtggatgcctgtaatcccagttatttgggaggctgaggcaggagaattgcttgaacccagggaggcggaggttgcagtgagccaagatcgcaccattgcactccagcctaggtgacaacagtgaaactctgtcgaaaaagagggagggagggagggagggagggagagagaaaaagaaagaaagagagagagagaaagaaagaaaagaaaagaaaaagaactgaaaagcctttacccccaaaggacatgatcacaaggtagacatttgtgtgcaaatatttctgtttgtgtttataaacagtatcttcacatatttctaagaaggctggttaagagaaaatatgcttacatgctttcctgagaacataggggaaatacattatggcttgtagtttataaataaaagttaactgcatactcatttcatctttacttaaactaaataatattccattagagtaaatgtggtttgtgagtgaggaaaattaatcaggtggtccacacctggactgaggcaacagtccgatagctcacggaagcatttcaagaaaaccatttagagtgtggactgtttcagaatgtgaacaacacacattaatgtcctgttgattttctttgatgtttgggcttatttgaacttcagtttgatgactactagccatattttatatgagatgtggtttagagacaacttttataaaaaccagtttgccttgtattcctaaacctatttttttaaaaaaacgaattaaacagagttcagtatagaaatttggcaactgtcttagttgctgaccccttagaaatctggttccaagtactgttgacaggttgttatggaatttaaatgagtgccacagtatttaaagctcaggtcagaagtaataaaaacatattgaagaagcaggctttaattctaaggaaagacagctggaaatctggcaagtctcttttgagtcgattaacccaattgcatcttgacagttgtacttttcatagtgagtaaaatttgattcaactcaatgtacattaggagcatggtgagatattcaaaggtgaaaaaaaagagactggcccctgaggaagtggaggagaataaaaacaagaaaaatgccagtatttattgagctcttactaatccttagacactattccaagcactagtcatgatggaatgcataaagagagatgtaactggtcatgtgtgtttgcatgtagctggtgcagagggagcagcaatgatgtcaaaatgaagtaactggcattggaaaatttcttaagatggcatgattcagaagtcagagaagaaaaggatggcattctgggcagatggaatcgcatgagcaaaggcacacttgcagcagaaactgcaagacatactcagaaaacagaaagtcatatggcttgactctatcataggcgtgctggatacagagggaacttttgccttccttagcaatagagatagtacgttatgtagttttcacaaagatatttaatctcatttggaaattcatactatgtaaaatattctcatggttctaatgaattatgtgaatatattttacagcatttcttcaggacatttataaattatttagactaaataatggcattaaattgaattatatttaataacttatgaaatagtcattaaataggagtttagtaaatatgattacatagtttatgctattttttcatctttgaaaatgatcaaaattatctttgtgctctagattaatttttgatcttatctattgtatcaattttggagaaaatcagtacaatttttaaaattttctttccatgccattaaccctgtgttgcaagtgtaattttgctctttatgaaccacccacattttcctacttattacttctcagtgattttccccagaagactggatcttgcatatgttcgtattcctaacgctatacctgaaagacacagaattacatagtagtagatatcggtcaaacaagcaaagggttagaaatgtctcctacggggagacgtgtttaaaaagtcaaatctagaattagattggatctctgtgaaacatgttaagatattgtgtgagctctttctaaagattcttagcctctgaagacaggttttatgtcttaatctccccaaaggttaggtgtatatttaaacctatgtgtatatacaggtggatatgcatagatgcaagggtgtgtatataagttcatgtatagaaataggtatggataattgcacatttaattgaacagcccttgttcatagatgtgaagtttttccattcttaaagggctaatttaattttactataacctatctggtttaccatataacaaacaggataaaaggattttaaagaaaagcccctcgttggctttaaataatacttatgagactcagaacatgtcacacaataagatgtttcaacttaacacatattgtccttatgttacttcatcttttatacgtataatgtcaaagacctctcaatctgacttatcttttagatcactaacaaggaaaaaaccagaggctttcagctaggtttcatgatggtcatgaatcccttgaaattgtatatatgcatgtacacataaacatataagtaaagtaacatgtgtgtgcatgcatgtgcaaacatatttctagagaggtctttcatcacattttcaaaaatatcacagtccccagaagtttgcttctgagtgtgaccctaaatagctttgattcgaactcaattataattaaagttaaaatcataagattttcaggaaaatctcatggaagcagagtagactggtaattaccagggattggctggggggtggtcctggggaggttttggtcaaaggatatgacatttcaggtagacaggaggaataagttcaacatatccattgtaaagcatgactgtagtaataacaacgttttgtatacttgaaaattgccaagagaatagagtttaagtgttcttaccacacacaaaacactatgtgagttaatgcacatgtaattagtttgattttgccattctataatgtgtatatatatcaaaacaccatgttgtataccataaatatatacaattataatttgtcaataaaaaataatataatcactattttttgtaatttttagcaggaactttaagaatgcttgataagttttttgtttgtttgtttgtttgtttttgagattgagtcttgctctgtcacctaggctggagagcagtggcgcgattttggttcactgcaacatcgcctcccaggttcaagaggttctcctgcctcagcctcctgagtagctgggactacaggcacctgccacaacgcccaggtaatttttgtatttttagtagagatgggctttcaccatgttggccaggctggtctcgaactcccgacctcaggtgatctgcctgcctcggccttccaaagtgctaagattacaggcatgagccaccacagccagatggtaagtattctttagagattgcaaaacactgcattattaattaaagattaagatacatagatactggaaagagacaaatagattaaagataaatcgattcaatggatgtggatcagaatccataatgttctaacttgaactgttgtttttctgtattccgtaatcataaaattgaggttttctcttaagtctacttgctaagataaagatatttcctattaatattaaaatttataatagcttcaaaagacttgttttagagctttaatgtgatgagatttgttataaaaaatgacatttaatggaatgtttctggtagaaagcagtgtttttttccccaaagctgtgcacagtgtttgccatcaggggttgctcttctgtcacactttgtgacactctcctcacaattacctgcttgatctagtgataataaatcccatcaccaaaaaacgatgcacagctacatttatagaaaggaatacatttgcaggatctccagtggtctgcagaccacagaccacaggctgactatggccgcaacttgtttttgtaaggaacgttttactggagtgtaccctcacccattccttcaggatttgtctgtggctgctttgcggctgggatcacagcattgaagagttccaacagaacaacagaaccacatgtttcacagagccacagatattttctaaccagcatttacagaacaagtgtgccaatcctcactctagacattcattgatttctcaatgtctgtcatacacgcctgttacgtgatcctcagctttcagccccctcgccccttagatctcacagtcaccaagccttctagggaaagaatttcaagcgcccctccatcttcttcatttattcgctggctcagttcctctctaccctgcaattgtttccttttttgcctctcctgcctcatttcttcccacttgaaaataataatttacttttctggaaataccattacctgctactcttgctataaactgacaaaggttcccattagccttaagaaaatggttagaatctttatcctgacagaggcggccttgaagaatctgttcctgagaccttcatttacagaatcctcttacagacagccctctgcccaagactgcctcttctaccacctaagtcctgcccacccctgcttcaggttgccccataatgcctcactgtcagtcaggcctttcacagcctcctccacctgcaggcaccactgcttcctccacacccctcagccatcaccacctctcatctatacatgaaacggaatatccccttccattggtggatgctgggtttgagtttccctttctacctcttctactagagttaagctcaccaaagcaagaactcttttatatctcttgacagcctcaaaacttagcctagtgctttgggcagagttaagtttaaaatatattctcatgtgtggttaaggatagctgcaatactagcaattgttgactgtttactacatatcaagattgtctcatgggttaggcatggtggctcatgcctgtaatcccaacactttgggaggccaaggcaggtagattgctagagcacaggagttcgagaacagccagagcaacatggcaaaatcctgtctctacaaaaaaatacaaaaattagccgggtgtagtggcacaagcctggagttccagctactcgggaggctgaggcaggaggattgcttgagtccaggaggtggaggctgcagtgagccaagactgtgccactgtactctagcctgggcaacagagcaagattctgtctaaaaaagaaaaaaaaaaaaagatagtctcatgtacaaagaattttgtaggccaaccatcaaacaaaaaaaaaaaaaaccaaagcaaaacaaaaacaaacaaaataaatccagtccttcaggagcttatggtcatactctgaccttattcttaccaactttgtagtttattgtctcctgtgacatgcaagaactgaaattttctttagaaatagttcctatactttttaaaatttaatttgtattttccccacttaattctcatgttatcctcagtttggtaagttagtctacatatctagcatcatagctcaaataaagtctaacatactttaaacccaattaataattattattagcatttattaagcatttgtttattaaacaccagtattattctagtacttcatacttattatctcacttaatctctcaaaactctgagcgaggtattatttttagagatgaggacacagaggtggtgaggtaatctgacccagagaatagaataggtcaggcttcgagcccaggtagtccatctcataagctcaggctggtcaggactgcaccgtgctaccgcagctagacatgaatctacgcaggtggggcaggggtgagaagctcaggtcccccgccttctccacacctgccaccccccagcccaaagagctgtccaaccagctcagtgtttaaaatccgagtcacttctcacgcatggaattctcacacaccacccgcaagttttgtattgattttttttcctgaagatttttaaatcatttgaaaggtatatttactctctttcaaaacccatgttttgaattaaccatttattcattcattgaatcaacatttaccgaaagtcttctgtgctccaggcatttggaataaataaataaaaccacagctcaaattatcttggggcatgatatgattaaatagttaatggttctgggatatcttaatgaaatccttaatagtaatgacaataaattaatttatcaaattatttgattttaaaacatgtgcagcactttatagtttctgcactctacactttaatttctgagcctcataataactctgcagggtaggtatgtaacattccttacagatgagaatatagtttcatcaagcttgagcaattttctcatggctctctcaagactgaagtcttccaagtttgggttcagtattccaaagattggggacataatgcactctaagacatagttcttgtactcttgaaaaagtaggtcatatttctacagaaaaggtcagatatttagctatacactttactgacatctacttaaatcagaagttgatcttcatggagtacaattagtttggtttttacctgtgaattcaattagcagtatgaacagatctaaagacaaatatttcaccatgtacttactttaagatctaagttctattaacaagcatgcttctctgttgaaagctgtactacagataaactgaattggatttgctggtataacagttaaaagatcagaatcagtttgcaagaggaaccaccttcctgattgatttggattctgtattcattaggatcctagaccagggcttctctcttcatccctttctttttctctgcttcctaacctgtccctctgtggtgtgtgtacatccttcagggataggacatcgatcaaaccatgcagcaatcccagaaggtggcatagcagaatacaacacccttctttaaaccacaaagatccctggggactatttactgtaaaatacaactacatggaaagtatcttaattataacataattcagttgtcaatatatctatattctacattgactccacctaaaactttgagttagaattacttttggagctttttcaaaatgcacacatcaaggactatccccagacccaccagttccaaatctctttacagtatttgttacagcctaatggacggtgctgctgtgtagctacatttgagaaccactggtcaaagggttgggacatgacccttccacccctttaccctcagagtcataaacagaagatgctgatgttaaaattaagatgtgtttacactgaagaaaactattttagtttatatatcttccaatttcacaagtagtaaaaggaataaaattatggggaaaatcattactacttaggctaccacactccaagaaacagaaattcaagaaaaggcatcaaggccaccatgttggggctcacctcactgtggagacggctgattttacctcaaggtgagacaggaacctagtccagtcctaacaagatccaatccttcaaccatcaagaggcaaaagaaaatatcacaagattggattggtcattagatcaaactacaagggaaggagagtggtgcaaataatctagtccaaggaggaaaatgaaactaaaagagtgtcttgtttgcatttcttggatgattagtgacattgggcattttacatatacctattgattactgtatgtctttctgaagaaatatcgagttctttgcctgttttctaagtgggttattcatttttgggtactattgagttgtaggaatttcttatatattttagagatcaaccctttatcagatacatgattagcaaatattttctcccataccgtatgatgccttttcactcagttgactgtgtcctttcctgtgcagaagcttttgagtttgatgtagtcccacggtttatttttgtttttgttacttgagcttttggtgtcaattccaagataattgaaataagaatctggaagagatatctgcattgttatgttcattgcaacattattcacagtagccaagatgtagaaacaacataaatgtccatcaacatttatgttgtcataaacataaatcaacagaggaatggataaagtgtggtgcacatatacaatggaataccattcggctttaagaaaatcctctgatatgtgacaacatggatgagccttgagaacattatggtaagcaatataactcagtcatggaaatacaaacactgcacaactccactcatctgagatatctaaaacagtcaaattcatagaatcagggagtggaatgatggttaccaggggctgagggaagggggagaggagaagttactaatcaagaggcataaagtttcagtcaagatgaatagctccagagattgggggtacaacattgtacctatagtcaataattatatattgaacactcacaaattagttaagagcatattacatgctcttacagtaaaataaaataaacatttcattgtatagccttttaaaaggctgaattggacagatgggaccaatggtaaaggataatatttgagaaatgagagtggagaacccctgcccaccaggtaaatgatttagagggctgcttcttccttgattctcatggtgatgacagcacagttgcttatgcatgaatgggatcaatagaagccttcttgttagaggttaccctgggggaacaggttttgtcacagaggtaacacagaagcacagctgtccccatggttctccttcccttccccgcttgtccccaccctctctgtgcttacaacaggaaggctttatcatatccataccactgcagtcttatcacaatcatcagacacaagaccactgctcaaaaatgagcaattattattttaatggtcattttaatggtagccattctgactggtgtgaaatggtatctcattgtcattttaatttgtatttctctgatgattagtgatgatgagcatttcttcatgtcattgctgaccacatgtagggcttcttttaataagtgtctgttcatgtcctttgcccatttgttaacggggttgttttttgcctgctgatttctttaagtttcctatggattccggacaggagctaaacattgaatccacatggacacaaagatagaaacagcagacactgagaactgcttgagtggagagggtcagggagcatgggttggaaggctacctatcgagtattttgctcaataccttggtgacaagatcacttgtacaccaatcctcagcgacacacgatttacccatgtaacaaatgaaccaaaaataaagtagaaaaaaacagcagggtgtggcggctcatgcctgtaatctcagcactttgggaagccaaggcaggtggatcacctgaggccgggagttcaagaccagctgaccaacatggagaaaccccatctctactaaaaatacaaaattagccgggcttggtgacgcatgcctgtaattccagctaccaaggaggctgaggcaggagaattgcttgaacccaggaggcagaagttgcggtgagccgagatcaagccactagactccagcctgggcaacaagagcgaaattccatctcaaataaacaaacaaacaaacaaacagaataaaacacaatccaccacttcatatcactaggatggctattataataatttaaaaaaggaaaaatagcaagtgctgctgtggatgtggataaattataatccttgtgcattgctggtaggaatgtgaagtgatgtagtcattatggaaaacagtttgagagttcctcaaaatatgaaacatggaattgccatatgatcagtaattttactcctaggggtgtgtgtgtgcgtagtatagtgtgtgtgtgcatgtgtatatatgcacgtataggagtatattctatatacaataaattatattttataatcatatgtataacatatacaatagaatgttattcttccacaaagaaaaaataaatttctgatgttatgtcacaacatagatgggtcttgaaaatattatattaagtaaaataagccaggcaagaaaggacaaatcttgtatgatttgatttatgtgaagtgccagaatgggcaaattaataaagacctaaagtatatcagagggcgccaggaacaggggcatgagggaatggagaattattgcttaatggatacagagtttgtttgagatgataaaaaagttttagaaacacatagtggagatggttgccaaatattccaaatgtaactaatgccactgaattttaaaggtaagagtggttaaaatggtaaatattatgttatacatacaagtattttattacagtaggaaaagaaaagcccagttaagctcctcttaggtccacacggccctaccttacctcccagcaccaacactgaatgatcagcccacttggggtcatggccttcgctgcagaatgcagtctacccctcactccacctgcagacaggctcccactcccctgtccttgggaacctcatgccagccaggtaggggtcactcactttctgagcacctgagcctacgttttgcctccgatccccaggtccttttcagctgttccgagcttcttgtctgcttttctccttacctagcttgcctttttggtttctataatattttttctggtgctggtggttggcccagtctttgcagggactattcagctctctgtatttggcttttccaaatgtcttgtctgtttacttggcttctgccctttatctgtcctcatcctcccacctcacatagcccaactctagtctgctcccgtcctgacttgctcctgtcctgacttgctccatgttctgggcctgtcatacctgaaacacaaacttctttgtggttctaagcacctgacttttaagtgagccaattcacaatcctaagtttattccaggaagcctcaactcggcttcgtagaggaatcacttggagagctttgaaaaatactggtaatcaaggtagaaatttaccctgaagacatatctctagaagtacaaaatactataaggcacaaggaggcattgtttataataggagaagccaggaaacaactcaagggttcatcccgagggtactggtagaataaacagtggcacacccatccactatgcagccagagaagaggatgaacaaagagagcggtgttggaatgatcccaaggataagtcgttttaaaagaaaaaatactgtgtagaatgatatatatggtgtgcaacatttggtaaggacagggaaaaataagaaaaatatgtgtaagtttacgtatgtgtatttgtttattttttcaaaaagaaacagtggcagtataaatcagaagctgacacaaatggttactaagtagaaagaaaaatgggcagagaggctagggaaagaaataattttttgtgtgaacctttttatttaatttcaattttgagccatgtagatattttacctattttaaataaaaaactacaataaatgaatataactgtatgccaaattggtacccaatcacaagagaacataattatttcaagtggctttttaacacagaactctgtgtatatactcaagacaaaggaaaatctaatgtgaaattttgacagtagttttgttagtactaatgttgaaatattaattttgaaattattatattcattgtataggataaataaatatattgtatacgataaataattttgacatcattgtagttatatacgtatgggataaataaatatattgttattaggaaccaagcttgttaatgttaaaaagagagagaaaaataatttaagaaaaccctataatattaaatattaaattttgatttaaaaataatttttttaaactttgacaacggaccaagaaaataataccccagtgacaataaaagcctctatcacccaaatattggttactacagactattttatactcaaaggatcttgcgttgcttagataaatggtggtccatctatgttagaacaatttcaagatgagcctgagacatattgtgccagaaaccaaataactgatcagacattaacagtaggttttcagaataactcatgaatgaacttatggggactcccactttgcaagtttggaaaaaaaattcactatatttccttctttttatgattgaatagtattctatcatatatgtatatatacttcaaaatatcatgtgcatattaaatacatacaattttatgtcacttaaaaaataaatctgaagatatttcatatttgtttacaaagcataaataagtatatgaattcacacttacaccaaaaaattaaattaaatttactagatataattgttatacaattcttactctgaaaaaaatggtggtcaaatgacaatgattatgcctttacctttacgttgctggagtaagagtagttcattcccagctaataaatttagaagaatgatagactcctacaacccctaatgaattcagtaaaactgttgattcagccaaacatcatcactggatgctaggatctttataacagggggatctgtctaacatcaacttgagtatcaataatagtgacctcatgggcctctagtgtgttgcaatatgaagtctacagcatcatctatgaggtatccttgccaaaatgagtaagctgaatctcatcaagcatttacgcttaccttccttattccagagaaaataacacagagaaacaaactagccaatactttgaaaaatcactcagatctatcctgaacacaggtactctacaagacaactggctgagtcttccaaacagactatatcgtggggagagggtaactagggagattgttctagattgggagagactaatgacacacaataaccaatgcaatgcaataaccttgattggatcctggataagaaaattactagggatgacaaaacaggaaatctgaatatgaacagaatactaaacgaggctaagaaagtattttttaatattctaaggagaataatggtatgtgactatgtcagtggaagtccttattcttagaggtgaggtaaaatgatgtctgcagcttcccttcaaatggtttagatggaaataaataatatatatgtatgtctgtgtgcatatatatattctatattcacgcacacataaaagtatgttatatatgtatgtatgtgcacacacgtgtgttcccctgcatttgtgcatgcacaccaaatataacaaactgttaacaatcattgaagctggatagtgaataaggatgtttattgttccagtttttaaatgtttccgtatgtttgaacacttttatcacaaaaatcagaaaaagtacagagagcaggatccacccagagagattcagatgagccaggatggggcttgggcatcagtactcttaataaactcccatgtgatactgatctacagccagtgttgaacattgccctcacccatcatgccccaccatcctgccacccaacctcactagattctggcatctcctggccctacagacacctcctcagagctcttgatgcctcgttgagccccttgagtcaagactcctggggagctctttcttcaactcactatacaggcctttttggacggccaaacaaaatcccaccaggaagacattcatcaaaaagagaggtgtcatggaaaactgcaaaggcagacaaatgtgaaccataggggaagatatgggcctaatatgggaagcagcaacactaaacaaagccgtaaacaactcaatgaaaagacctagggaaaaaagcaaagaaagtggaaagctatactgatgagagtcccaaaagtaccgctaagccatgaggtcatgcttaggatttattcatgtcagcgtcatgagtagtgttaaatgaggagagctatcagagagacctttgtttcagggattcaaaagctgggacccagggacacaggacataagtagataggcctaggccactaccagtgttttcactagaagagaaagtaattttggaagcagcacagatgtgtgtccccagctgctctgcctccccttcccctcacaaagacgtcatccagaaccctggtgaaatgcagctttccaaaaaaatggtccacaacctgtaagagatttgacagtacaacacagcatagccttgcggctcatctaccatagaaaagtgattttttttttttttttttcgagacagagtctccttttgccgcccaggctggagtgcagtgacacgatctcagctcactgcaaccaccaccttccaggctcaagcgattctcctgcctcagcctcccaagtagctgggattataggcgcctgccaccacacccagctaatttttgtatttttagtagagacggggtttcaccgtgttggccaggctgctctcaaactcctgatctcaggtgatccgcctgcctcggcctcccaaagtgctgggattacaggcatgagccaccgcgcccggccgaaaagtgatctttaaattagggactgagtacttccgagcatacacactttccaaggtactcaggccagaatgatttcaggatcagattccaaatcgttagtccctatttttccacaactgacctgcttgagccagcacctgctgtgggggttgcatgcctgtttggaatctgcttgcccacaacttccttccacaaatgggcttctcacttcacaaaggaaagccatacttctcagtggtcaggaatcttactgtggggcattgcctacaggtggaaaatcttatcaaagggaagttcaaaatatttgtgttggcaaaatctcctttgcccaagggaccatactcttcaccattttttatcccatccatctccagaagagatgtgtaccttagaaaattagtttttatagttaacaattactaaatattttgaataaaaaaatctatttgattcatcatttactactaataagcatagtaaaactaaatgcagaagaaaaagtttaaccctgggaaccttatgtcccatgaaaattatttaattaagtttttatttgtaatcatattttgttgccaataactatgtgttatagacttgatccaagtggaaatgtttacttatattaatttatacacccttgtattttgctgtaaaaatagtctaaagtatatatgttgtacatacccaaatgcttccgtaagacttgaaagcgtgtctttgaaattgaggacgggaatgtcagggaacagcttctgctatatcgagtgtgttctgaacaaagttaatggagtgtaaattcatcaggctcctaatcaaaggtttgtctcatctggcttaaaggcaattaaacataaaatccaagatgtctaacataagcaaaaagaacagtttagcttttttggagtagcctaagaaaacggctttctgctgaagaaaccttattctggcatttaaaagttaggtttcaatggaatgaaatcaaacgtaaattgacaaagacaaaataagaaaccatcaatgattgaaatattgtttgtgattacacaaattcatgggatatactagagtcatgagttttgttctcctgggatgtatttgcaattaaaagcaacagattaaaaagcaacttaatttattcacaaactcacccaagaaaaatgccatccaacacactgaagatttctattcattcaggaatttgctaatttccctgtagtatatgaggctggtatttttatactcagcccacatattagtaacaggacttctgatcctagctgaaattctcttttattatccaaaggctcgtcaaactggattatctcgaaatcctaatcacatctcatccctccactccacctctgactttcagcagatatcttgacctttcatctcacagcttcctgctaacaagcccctagcccatatgtgcccacaaatatcatttccccttgcatagatattatgacagcgggagtagctcatcatatagagcgctctccccaaaataaccagtcttcatcttgttgttaaagccagtgagtatctttcagttgttatatgactgccaaatgactctttggcagcattttacacttctgaaaatcaaaatgcaactttttataagcattttgattttaatagaactatttagttacatgccctacatggcattttctctagcaggaaaatgaacagtttggtcttagaaagatttttgatataaatatttcaaaaataaatgatagcaaatacttattgaggatgtaaatattccaatatttattttaaatacttcatatttattaaagcatttgatcccccagataactctgtaagatgggtatttatactctctccattttacagatgctgaagagaaagtgtaaaaaaattgctccaagtcgcagaggtggcaagtgtttgatctcaagttgccttagcctgccctttacctaccaaatgctgccaagttacctgtaaaattcacttgaccagacacatcgagcaatcagattaattgagatttgattttaagatgggcagcattacaaagaatttatagacaggtagtgagatacctagaaagacagacggatggtaagaatgagctgattaagaagacacctccatgtgaagtagctatcagttggtataccaaaaccaaatcacagaaagattaaagaacttggaggttatcaaatcaagcctggaacagaattttctaggtcatatgcagccaacaatgtttcctactagactgagaagaagctacattttcttttaagcactttgctaagtaaaattacaaagatggtagaaagaagaatgcaaggttaatcaataattaagttagaaaatgaagttttgcttaagatattagataaaagcattcaagcaattaattgaaatgcatataatgctgctgctatagaaatttaggtaacaggcagattaagtaaaaattgatttttcttgcaagacactaacacccagaatatcaaggggtggacaaaaaagaaatagtactaaacaaatttttttgaacccaggtgatcaaaatgttatacagttttccaaattcaaacactatgaagctgtccttagataatggccctaccattttcccattactttgcaactttcatattgctctacatcttcaaagtttttctattagagatagcggatatcactagtagctttaaaataagtgattcttgacccccatccggatattaagtgttttgcatgttcagactcatgttaggtttaatttaaagagctagtggttaggcactccatagaataagtgtgaaacaatagtcatttacgtgaattaaatgtttgacattagaagtgttttgagcctagaaacagacacataaatgatcgtagttaatggaaatactgccatgcttaagatcattcagcacttctccagaatgcaaagtatatttagaattagatgcagatttacatgtgaataaaagattttctccagccttactctccaacatccagagtaacaacagaacagcaatgagaaagagaaagtgacatgaaaataatttgaaggcaaaaagcaagaatgagaaatgttcatgctcaggtaaattctgagaacaaggtagtgctataaagaggggaaagaatagaaagaagtattaattaatagtcactaaaaattaaaaagctgtcccacttgaaagtattaactgggttattaagagaaaagaggaaaaattactgtggactgtgcggtgtggatctgggacaaaaggtagtataggaaagcataatttatggaatagaaagctatatggagttttaaaaataagcagtaattttgaccaccaaaatagagatgattatactcttaagaggaaaatgttgagttgtagccatagtggggttctgttacagcaaaagtacaagacaatggaatatgcagctattaaaaattagaagagacaaggccaattttctgtagtactggaaggttttggtattcactaaaattaaagatttaaacaaaaggaaagtcatcaaatgtcttttacccttagaatgcaccagtatggatacagttctggaaatgtactgtacaggcatgagttcaagtcctctgatgggccagatggatttttatctcctcatccaggagcaggagggccagcacatttcttgcttttaatgatctgaggcttccaatgttttccttttgtctttctctagcatctctggcttgttcttgagcctatttactcttgtttcatcttcctgttatttatatatattcatagcaaacattcttctgcattcattttaggaacaaaagcttatgatggtatataaaattcttatctttaccttccttctctctatattgaaaaataattcctttaccttttattcttagaaatactatttcactactctagtattcagaacatacctcaatttctccaggttaagtttctgaagttcagcaaactacatggaattccaataattcaaagtagaataaccatatggtttcacaacacactgttattgttttttgtttatctcttttgaaaaactttaaactgtggattgcttcatcttttggtaagctaaactcacagatattattgtttaatatgtacacttgatcaacttttcccatattgcatttctattgaaaatttattttgctaaggttatcaagctagttctccaatttgttagtcaattatatttttggttttgacaagtaagaaagcttttattgaattttcttattacacatgcatttatattatttaaaaatacatattcatagaaaaaagaaaacatagaaaaccgtaagagtcactcaaaatatctcaacttgcagataaccattgttaacattctgctatgcatcatcatttagaatcatagagccaattctcaaagagtaatagacacaacgcttcacctactgttgtataaaaactggcccatgaattaacatagaaagaaaatgctggttcatgataactattgctgtatgtgtgtctccatcaaccactggatactacctattcttctggggatatgggatgaaatattctctctcaggaagacacctggatagcagggcagaaaagccattttacattcagcctttttgacaaagaagtaagcacttgaaaaattattgactttttctgttttattttctagtatagcattcaattgatttgaactgtttctttttaaaatatattttgcatagtgtgtcatggtgtaaaacacacaaccattatttcaacaaatattcattgtctaactttccttttggcaactgatgctgtggatatagtcgatgaaattttaactttaaataaaagctctgtcatatcttaagaactctaaagctatacaattttaaaattctcaaatttcaggggaaagcttgcatggagattggattatttacttctcacccaaaccagctcttctctctcaattccctgtgtccatggttaccagcatcattcacttgcttatctaagctaaagaggccttggatcttttctctcccttcatcccaaccattataaagtatacagttcagtggcattaattatattcagaacattgtacaaccatcaccactactttttccaaaactttattcatcatcccaaacagaaactaccgcacccattaagcaagaactcccatttcctccctctcctttgctactgatcatctctaatctactttaggtctctatgaatttccctattctaggaacttcacgcatgtggaatcatacaatatgtgtcctattgtgtctggtttatttcactgagcataatgttttcaaggttcattcatgttgtagaacttcactcatgcatcagaacgtcatttctcaaatattctattgtatgtagataccacattttgtttattcattcatctgttgatggacatttagtttctgtccaccatttggctactgtgaataatgctgcaatcaacactggagaacaagtatctgttttcgtccctcctttcagttcctttgggtatatacctcggagtggaattattggtcagtatggtaatttcatatttttttgagaaactgtaaaattgttttaaaacatatttgcaaccatacttcaattttatatcacaatttaatagttaaataccaacagtaatcttttaataaaagtacctaactcttatggatcatttcctgtatgccagcatctcatctaatttttctcaatgattctgtgcagtaattaccatcattagccacattctaccaagaagaaaactgggactaacaaaaatcaagccatttgtcccatctggtggtagacgggattggcaggtaattctgtctgtataaaatacctaaagaagatttaactgttgtcattttacaggtagaatcagggccacaatggctagaacaatttgctttgaggtaacaagctgagtaagtaactgcagggtcactagaactgcagagttacactagaactcacttcttaatgacttgcccagctcttccattgcaccaggatgcctgcctcactcatattatatatatatacatatatgtaaaagataatattgtgatcattgtatagctacacattcatatttactcttaaactgaagtccatttgtctcataagtaaaaagagagaaaaaactggagaccaagattattacaattataataaacctgaagtatttatggaataatgcatttgtactaagcatcacaccaaatgttttacacacattatcttaacttcacaataaatctatgagctaagtgttattatcacttcctctttctgtatgaggtataaagtagatatcagaaaaaccaatgaacttggaaaagtgtacacaaccactaagttgtaacgcaaggcttcaactctcagtgcacccaaagtcaaagcccatgatgttaactcttcttattctgtaagagttatctatcataaggaagaaaatcagatgcaaagaggatttgtataacttttactcacacttaaaaccataagaaaccctaactcagagaatcatgaatgcttatgattttattatttaaaatttttatgtcttaatgttctattctttttgttacaagtgttaaattcataaaatgttggttgatcctagattccttctaggaaaggcaaaatgggagaaattcctcaccactgagcaatgccaatgacttgaatgaagtgactaaaataaattaacacgagtggtgttcacaatgagattgttagaagtgctacatattttttaacaatgattcttttgcatcatgttagctatggagtctcagctggcagctatcagctgtctctagctgtaaatgacagcacaagtgagcagggctcacctacacttgctctgctcccactgatccctccatccccatctcgcagcggtggggaagcacctgccccttccaggaaagagaacacctttctgaacactgcctgccccagctctcacagagaggcagtgggttcagtgtcataatgcggtcttcactccacatcccggatatccaatcctgactacaccccttactaacaagggaaccttggacacgttgcttaacttctctgtgcctcggctttctcatctataaaaaagatgatgatagaagcatttaatccataaggctgttgagagggtggatccttcaaatagtagcccatactaggagctcagtagctgtcggctaatatcattacttttatcattaacactatctcccaggaaaggttagccattcaggaactccagccccagtaagaaggtggacaaatatgcctgtggctgacaagtggattggccaagtagaggtaggaggtccccgcggtgttactgttaacagaaagctgaagttgattctgtaattcccatttggctctgaacccacattctattgaaaggaagtttaaacttgttctagcaaatcaaacttactgggcttttaaccacatgactcaccccaatgtgagtgctaattctgaaaaactccaccctcacttccccatgaacacatgttatcactctagagtcactgaaaacagacaaagggaaatgaagcatgaagctcattctaggtcactggcaaacgtatgtgaaaaagtgctgtcttctgaagagaagtgatttatgttggaaaaggttaatggcattctctttgacataggcaggcttttcagtaatactgagttctcttaaaatttaaaaattaggctgggcaaggtgactcatgcatgtaatcccagcactttgggaggctaaggcaggcggatcacttgaggtcaggagttcgagaccagcctgactaacacggtgaaaccctgtctctaccaaaaatacaaaaattagcctggcattgtggcaggcgcctgtaatctcagatagttgggaggctgaggcaggagaatcgcttgaaccagggaggtggaagttgcagaagttgcactctagcctgggcaacaagagtcaaactgtgtctcaaaataaataaattaattaaaaaatacaaaacttagccgggtgtagtggagtgcacttctggtcccagatactcaggaggctgaggcaggagaatcacttgaactcgggaagcagaagctgtagtgagctgaaagcacaccactgcactccagcctgagtgacagagtgagactccatctcaaaaaaaagaaagaaagaaagaaagaaattaaaacttccctttaaggattttttttcactccatgttgaactgattactgaggacattgactaaactttgaagcagagcagttcattaataaatttgatgtgatacagttttacatgtttagaagaattccacagagtggacgagcgttgaacctggcatcaattctctcctttagcaaaacttggaaaaatattgatattaaaactctgttactattggaagagatttctgtctctatttgacacgaataaagaaatgtatattacatgagtatttcccttcctcaattccttacaatgtgtacacactagttctctttgggaagaaacaagccaagcacaagtttcaaaaaattcttactgataatgcacacaggaaggggaacatcacacaccggggcctattgtgggatgggggtaggggggagggatagcattaggagatatacctaatgtaaatgatgagttaatgggtgcagcacaccaacatggcacatgtatacatatgtaacaaacctgcacattgtacacatgtaccctaaaagtataataataaaaaaaaagaattaagagccaacctggtaaattaaagttctccattgcagatctattctattgggtaataaaatgtgctttccttgggccaaaatcagcaatagagtgttacattagtttcctgttgctcctgtaacaaatcaccacaaatgtagcagcttaaaactacataaatttattatcttacagttctagtatctcatatttaaggttttagagaaagtagaaccttgaatagtagtccatactaggaactcagtagttgttggctaatattattactattgtcattaacattaacacttactatctcacaaaaatggttagccattcaggaactccagcccggggaagaagctgaacaaatatgcccatgtctgacaaaaggactggcaaagtggaggtaaatgagtccaaaatgggtctcactgatcaatagtcaaggcagggctgtgttctttctggtggctccagggaagctgggtctacctgctttttcctgcgtctagaggttgcctgcattctttggctggtggcccctcctccatctttgcccgaaatgatgggttgaacctttcacgtatcacatccctctaagctcctcttctgcctcccttctccaattttaaagacctttgtgattacattgggtccacctggataatgcaggctcatttccctagtttcaagccagcagtctggcaaataaattcaatatgcaaattaataccccctttgtcagataactgaacatatttataggtttctggaattagcctgtggacacattttggcaatgacggttctacctatcacaggtagaaaataaaaaacaagaaaaataaagtaaaaagagagcgtacaagggaaagccaaatgccctaggatgacactttcaaacatcacatccacctgtcttaatctaggttgttgaagtgaacaaacagctgagggcatggtatatttaagcttctgtgagggaaggacaggcctccctcagcccaggactgaaatccactatacccgaaggctataataacagatcaaatgctcagattttactctgaagggctgttcatagtgtaaatgttgcccaagagccattaaatacatttgcccccactttttgcttaaatggaaattccaccaagtgaataaatgcatagcaaaactaggtgcattcttgcattgtggacagtcaacacacctaaagagtgtgactcaaaactaattgaaattaaaagcaaaattctccaattgatgtgtttctggtgtcccctcatagacatgaattccctcctttgcctctcccttatgtttctgcctaaagcagcaggcaatgaaggctaaacctctgaaagtgagcagctgaaaaattgggatatattgctggcgtacttgctacttgtgaaatatctcctgtgccaataatgaaatccatcatgtgaccagctgtctttgcaaaccaaagaggtagagcaagttaaatttctatttcaactgatgctttttataaagaaaccacagcagctctcattgtttatttaaaattagtgcaaatgaaagcttttaattgtctctgtgatgtggcttccttcctgcttaagatgagctcatggtgcctcctccatgatcctctcccctccccagcctggtctgctgtctcagccgtatgcgcaactcattctcatctccatggtgtcactcatgttatctggcctgaaattgtgccttttctctaagccatttcaatagaataaattggaatactattttctatatgaagctttggtcaaatactacaactcagattaatataaaacactccaaaatcctatagtatttaatgccacggagattgctacctaatttgtttatgttttctttttaatcttctaagatgttctaggctttatttgactgcatcccacatcttgtttcgtaattttcttaggatttaaggcagaacctaatgttcaaactcactggtaatcacggaaacacaaattacaacagtaagaaatgatcaaataacgtgagattcatcgaaatagcagaaataggaaagtcaatattaccaactgtgactaaagataggaggaattaagtactcttacgtccttgtaaagttgtgcagccattctggatcagattggaaggacttgggaaaataagttttttttgttttgttttgttttggttttttttgccttaagacacaatacactctctcctgaatatcccagagatattctcacaacatccatcagcagacacaaatgggaatgttttccatggtctcctatgtgggaatggggagttggcgaccaccccagggtccatcaggggagaggaattgtgaaatatactggaaacacactgcagaatagtgtgcggcagagagagacaacacggggagatcttacacacataacattaaaagaagaaagaaaatacaaaatattttctaccacagtactacttttgtaaatttaagacatatacacataaaacattacatattggtacattttaagacataattaactcaatctgaggtccaaactaaagcagctaatgacagacagatgtggacatacagaatctagcaatgtcatgtgaaagtcataggcagttttctgtctcgtctcttaaaaggcatacttttctttctttctttctttttttttttttttgagacagagtgcccaggcctgagtgcagtggcatgatctcagctcactgcaacctctgcctcctgggttcaagcaattctgccacaggtaattcttctgctgcagcctctcaagtagctgggactataggtgtgcatcaccacatcacttggctaattttttgcatttttagtagagacaaggtttcaccatgttggccaggctggcctcgaactcctgacctcaagcaatccacccgcctcagcctcccaaagttctgggattacagctgtgagcccctgcacccggcccttaagtgggtttacttttgactaaagataacattacttatcctttaattaaatccaaaagtgagcaatgaaacagtgagcggagttgttaaaaagattttcaggtgttctgttgaacctgaatgcatttccatttgagcacttgcatttatctctgaaaacatagccaccagggagctttagaacatctgctatcaaaaccatcaaaactgaaagcctttctattccatctcctacaattatattgaaatggattgttgaccattattttctatcttcaacacatttattttcatcagcgatttcccaccagcacagcagtatgacatttaatggaatagctattgtgaaataattatgtttaccattataattctaggtctgcactgattttaatcaaactattccaaatagctttttgatcatagttattatatacaatttagaataatctgatcaggttggaatagcttctcctaattaaacaagtgtgtacataaaaggtgtatatgaatggctgtttacattttaaggaataaaagaaaatcagacttacgaatgtcttattaaaatgaacaataatttggattgtgttaaatcagttctctataacatgtgtgcatttaagtatgtatatatattatagaagtgtgtatatgtatcatagaagactaaatatatggtaaagatttctatagagcataatatgtaaagtaagagacttatatagaaatggaaattcagaaggtaaaatttcccaaggaaaaatattcattctaatatatcaatcatgatttactaagttgcaaatctttttaaaacagtcccaacattttagatcaattgttaaccgacaattggcttacacgaggtggattaattagttactagcttcatttgtgctttccaaaagcatgttttagcttttatttgtcatacaacagagttaagcatgggctaccttgtttagaattccctcgttgctgcatgtggaggttaatactcatgtcatgagcaccaaaagtctggtcagtgtgcatggggaatggactattaacattgtttcttccctgctgtttcttctaggaaaactgacacgcttcacttttcttgatctctttctacaaaacacacaaattaagcaaatatctgaacacaccaacaaacaaaagcaataaacaaacacttcattttgtcatctttatttttatgtagtgtttattacattaaaacacatatgttatatgtatgtcttgaacaaggcactgggctagacactgagtattgaacagacaaataagttatagtccctgcctgtaagaagactaaaatctcttcagaaaagtgcaggtgtcatgcattctaatgaaggacatggtaggaaaaaagcctgtgagagagaagtgtgttcagtcaggctctaggttatttcagtcccgtctttcatggctccttattcttcccattgcttaggaaaaaaaatccctaagcagtgttgcttgaccagacctgtgtgcttgtccccaatatgctcaagagaatgatacaggtacttttctgcccaccttgagataatcaattgtcctgaatggaaaatcagtgctatgattggcagccccatacaggcaagcatgtatgttatacctccacgggaatcagtaatgaaagtaatgatgggcatcaaatattatgtagcctgtcttagcatttgtgcctttgcacacaatagagttaatatgaatcattttggtgtagaaattgtgagaacaaggtcactgtgtaaactgacaaagagctttcctctcaagtgacaagttggactaattgcctggggccccatgctgaaactcaacaatataatgaccagcgtgttccttatagtgactgatatggcatctgagatggaggaattcaaaattgagtatttgttcgttatcattttacaaagtagcttaaattaaggattttttaattaaacaacaaaaatctctgttgatacaaatgtttcctggtcccttctagattcttaaaccaaactttttcaatgtagcctcgggccaaatttctttgaactaaaaatcagccaggttcagtggctcatgcctataatcccagcaatctgggaggccgaagtagagggattgcttgagtctaggagttcaagaccagtctgggtaacatagggagaccccgtgtccacacacacacacacacacacacacacacacacacacacacacaaatccgcgtggtggtgtgcaccaataatactagttacttggaaggcggaggcaagaagatgacttaaacccacgacttcaaggctatagtaagctatgatcgcaccatcgcactccagcctgggtgacagagcaagaccctatctcaaacaaacaaacaaagaaaaagacaggataaaagtcacagaaatggtctacacactaggaaaaaatgtgacaattttttcatgaacacagcattgtctcctcttcaaagccctccatgtgccccagctaacatctggtatcaagtcaattacgtggaacaaagtctgcttgcaccatgagaaagctcagcagcatttagtttctacaagccatacgaacaaatagcacatttacaggaatgcaattacaaaaaagctttatctgagttaaacttggaattctcattaaaatttttttaattggttgtttttattacaaatagtacagagttaaaaatgataagatactaggactttggttaacagctctgtaatggagtttataatatttggaaaactgcctgtaaacagaatttctctacatgtgggatttgaagtgcaattgcaatgaaatattgtttgtttttgggacggagtctcgctctattgctcaggctggagtgcagtggcaccacctcagcttactgcaacctctgcctcccagattcaagtgattctcctacctcagcctcccgagtagctgggactacaagcatgcatcaccacgcccggctaatttttgtattttgagtagagatagggtttcgccatgttggccaggatgctctctaaatcctgacctcaagtgatctactcaccttggcctcccaaagtgttgggattatagacatgagccaccacgcccggcccccgttaaattttaaataagaattttgctctaaatctttttacttaatttacatatcttgatgcatttgcttggagagctatattccctaaaagaagtaagatcttcagcagtaatatatcatattgtgacccagaactctttagcttaatgataatgataggattttaaaatttaatgctccattctatgtcattttacaccttaacaataaaaatattattcatatctagaatgcaaacactgatagttgatatttatcgtgaacttattagatgccaagtactagtttaccaattatatgtgttttaaatcttggaacccttacagcaatcctgtgaagtaagtgttatcatcataattattacctgtgttttagagatgaggaaactgaggcatggaaagtttagagggcatgtccaagatcacacgttaagtggcagagccaccgactggactcaggtagtcttattacacatttgagctcatgcctcccataacaacaacaacaaatcaacagaaaataatcagctccaacacacccacagcattgcttagaaaatgggctccctgattcaaatggctttaattgcaaaaggcactatagcaaccacaatgatcctcttggaagagttagttcttctaggatcaacataggcagcaagcctagctgtaaagcagcccacagattaaataaattctatgggaaaaaaaaaaaaaaaacctgagactgataaagttagtccataggtttgaaccatgaaataatccaaagtaagtatgactgatctgaatatggaaatgtactgtgttcagttagcaaaataaaagtggcatattcttctccatgtttatcttaactagctcatatgtatttgatgtatgccagataaaaagaaaacaatgatccagagctatgccctgcctctctcccatacttggctaatggaccagtcatggagtttttatcaagacggggagaaaacctgggacattagattacttagtcgaacaatatttacgaactttgtgacagtgataagagcctgaaactaggccatactgctctttatattttagaaacagcaatgaggtcacttttaaactatgctaaagtttggctactaatgtggtgtggttgcttcattatgctcttaaacagccacaccagccattccttcagcactgtctattgggcactctataaaaatcccaacttttgtttttccagtgatcacaatatattcatgctgaagcaacctcatttcagacatctatccctcttggcaaccaaaacaagataactgacaaggattaaaagccaaaatttatgactaaatagtgtttattgactttgcacaactaactgcaaacttatctcatagagatatactccggacaagcaaataaaattacttgagcaaaagtatctcgaaactacacatagttgtccaggctgtagattattccataataaaatatatgcaaccaagttgtttggtcatatgcctgatgtgtcccaaataagtctggactctggtaatttttaaacttagatgaggaatccctacaaagaaatggacttaagcttggtgcaacccaaggaacttgttctggactgtcaacaccttgaatttgtaggtgaaacatacatcctagttcttgtttactttccaggcataataattaataactcctcattttactctcaaaatgtctttgtttgaatgaattgtagtcatgacacatcagtacccttcaagtctgataacacaaaccttgtgaaatttatagatcttgtactattgtgttattgtcttttagggccataagttagatcacatccttcaagtgggtaaggctttgtctgaaaagaatgatggtctcattgccaatcaatgaaaaggatgagccttgagataaaacatggtgacacaggaggtgggcctcagtccagggtgatggaggagaaaagcgctcagcctaggactgggatttcaggtggcctcagacactgaagttctgagaagtccttgtgagggaaagtggaccgtcccagctgaaatcccagtcctaggctgagtacttttctcctccatcgccctggcctgaggcccacctcctgtgtcaccatgttttatctcgggactcatccttttcattgattggcaatgagaccatcattcttttcagacaaagccttacccacttgaaggatgtgatctaacttatggccctaagacaataacacaatagtacaatttctatgacagtccagaacaagttgcctgggaaacatggaaaacagtgcagagctggatcctgccatccaaggccagagtggcaacacaggagtggcccacagggagaggcagtgtggtgaggtgtcagtccatccaatgcctcagccaccgaggaggccctcagtgtcctgaacaggctcatccttttcattgattggcaatgagaccatcattcttttcagacaaagccttacccacttgaaggatgtgatctaacttatggccctaagacaataacacaatagtacaatttctatgacagtccagaacaagttgcctgggaaacatggaaaacagtgcagagctggatcctgccatccaaggccagagtggcaacacaggagtggcccacagggagaggcagtgtggtgaggtgtcagtccatccaatgcctcagccaccgaggaggccctcagtgtcctgaacaggacagaggagaggacaccaggtacttcctcctgaacagaaggagctgggcaaattaaagggtgctcatttctagcaataaatgtgccattaagtgaagcaaagttattgtgcaacatgggagttgttcacaaattgttagcagcttacataactgatcacaactggtattgttttcatacagtaaaaccgtgttttagtgtttcagttcttactttataattgctttgggatctatgatcaaatgtaaaagctatgagttttctgagtactgtgtactttttatttatcactatgcacattttaaagcaaaagtggtttgtattgcctaatatgtaaaattccctttgatggtcttgctacaagttccatgtaaacaatgtattccaacatccctgtggtcttttttgaaggcagagatggttgcccttgtcaagatagtataatccctgtgatcaacagatctgagtgtgaatcttgggtcttccacattggagctcggaagagtttgaaagctcataactcatctgagtctcagttttctcatctatgaaatagaaaataccactagccaggcgtggtagcacgtgcctgtaatcccagttaatcgggaggctgaggcacaaaaatcactcgaacccaggaggcagaggttacagtgaggcaaaatcatgctactgcactccagcctgggtggtagagtgagaccctatctcaagaaagaaaaaaaaaatagagaaatggaaaataacatatatcttgcaggattagtataatgattaatgataaaatatgtaaaatgcttagcaaaagagattagctaatgataatattattattaatccaaagaatgtgtccccattcatcgcctcatatgtcctatgagcaatgctccacggatgactgctgtggagggggggatggcatggaagagataatgctagttaaggatggaaggagagggacttagaataggctcttaattcctagaatcagagggcactgggcagaggagtgagaaaatcaaagagtagtcagttatgtgaagaaacgaggaaagaccaagatgtttctatcccaagaagctttcagcagctttcagcagcttgatgctgcaggctggagagctatgggaacaaattcacccactcaacccctcccctgccagcctgctacaaaccaagccagggcaggaacggcatgccttccaggggtgcctgatataccagatattttcattgtcatgtaattgttttgcatgaaacacagtggattgaaaatatcacataaatgtcattacgtacaagccttcgtgtaacatcaagtttatggtggcagctttaggtcaaactcttcaagacccccccccccccttacagcagtaagtcatccgtgtttggtgctttggtggaaaatggtgacagagtagtaagatttggagaatcttattagttgtgtggccttgggcaagccctccatctgtgctcatttataatggggataataatggggtctttgaaaagttgttcaaaaaagttgtaaaagttaaaacttgtactagacataaataaaatgactacccaatacagtatctggtatatagcagatactcaataatgttaactaattttgctattatatttaaccaaaacagactcagtgctttctgtgtactaggcacaatgtttgatgttggatcatttcagatgcaaaagaaatgtgtgcctaagccacccagggattttcatatttttctccccaacttttacttcaaaaagaaacaaagtgtatcattccattattttagagataaaaggctgaaaactacctgtaaaaggtaacagactgctatgaaggaagtccagtgtgcatgtgatttatcattacctatgctgataaggggagtgagaaaataggaaaatccaaggtatttaaagaaagacagctgatacctctaaatagggataaagtagcagaacctgaacttaataaaacctcaagatgaatatgaaagaggtcacaattttttgaggagactccctgaccctttagcagaaactctgcccccagtactcaatctataaactgggttatgagaaaattcaagaatagaaactgacaacatgccttgttgtattgtcgtattacttcggcaaaaagtgatagaaactaaactcaaacccaaattaacctaagcatactaagaatgtattgtgttaccaaatccaaggatgaattaaatgaccaaaaaaagaaaagtggggttataggaagagcagacagctgcatcctcacaacagaaaccagaggcattaatgccaccaaaattttctttcccattcttaactcaccaccaacatttgacagtaaacatggctaccaatagtttttcagaaaatatattgtagggcttcctctactagaaatagacctactctctttatcagcactagtttcagaaatcccaggggaggattctagttggcttggtttggacagggagtctattcctggcccaatcaactttggtcacccaggaaaatggacgtgttgaatgaaggcagtgactgtttcagagacacgaaacagaactggttgtacacccagtagatgttcagtggagccatgagttcaagagccatttctatctgggccttttctatgagggtcagttactgctacgttaaacaagacagttttctctttcatgtagctttctagtgatacttatcagtacaaaaacaagaaacagtttatgaacgaatgcagcaatttagaagagtttttaaaacagatttcaagacgagaaaatgcatttgtggaaaatgtacttactttttctcaaagaataacagcattttgctggacaaaaggaacctgaaaatcatgaggagttatactattgtaatttcagaagtttctctagctagataactgctagggttatttctccaatacataattgtgatgcatttggaaaacatattaagctcaattacataggatttttctttaagtataggtatgagttaacactatttagttatttggatgctgaatcataatgtaccgaaagaaaaaaagaggcagctttctctgacttactgcataaatttatgcatctaccactagagggcacaaataaggctgttttctgggaaaaggttttgaaaatgacaaaattccatattttggaacggtgactgagttaagatatgtagatatgcatgttttctttaaatctgagaagaaaaatcaaaacatactcatacttcaccgtgtaccattttgttctcttccctctttctctcaaaaataaagtacacatgcatgagggaaataagaaatatcaatggttcataagattttagacacaaataataaaaattaaatggctaccaagaaatagactagcacataaaaatactgctacagcaacatggcaaaatgccacaaattagcaaaagtattcatatttgtctacaccacacttacaatctttggagtgattttctcctaaatcatcaagcacaatacagttcacaaaactgatcccaaatcttgcaaatattagatatatattgcatcttttcttaacaaatgtagcactgtggtaaaaataggatatgatttggttgcattttcacacaatactgtgcttgagtcatgctcgcagaatacctccatctgcaacagctgttttactccttaaaaaaaaaaatggaaaaggaaaaaacccaacttctccagaataagcaaacagtccctaatcttgtcaccctggatgtctgacaagtactaataactatgactaggttttgataacttccttgatttgttttcagggttattattattttgctggaaaagggccttgtgagagccaatgattgtattggaaataaagccaaaacaaagttcaaagcttgctgagatgcctctaaggtagaaagggtagcaaggtgaatggcatgatgaggaaagtgaaaatgctgtcgcaaattggataaaagtgatgagttggtagcttccatacctttcacaccttgatgtttcccatcactaattcacagtagcatcaagaatgtatcaaaatgtagcttgtcttcactttattaaaatttctctaaaacacaaattttgaatgttataaacaaggagttaatagatgttcattcaatcactcagcttagtcccttccaatgtttcctttaaaaacaacatacgcttttattctctttttaaaaaatgctctactaaaatctacacaccttctgcaccttctataaacattttgctctagtccaatcctgtttcctttcctgcttcaggttttgtcattttcctcctgatgccaacttgagattccaccatggtttatccccatacatggctgaatccacagaaaatggcaattatgacacagatacccacttatcctcccagtgatggtcatgcatgtagcaataagaatcctttttaagaaacagcacgtctcaatctgagccagagggtagagtttcctctacaaaatactttcaaatgctttgtcctctagaatttcttgattattaatggttttcacaagtatggggggttaggtgggccacaaactgcttccaggtggcaaaataactattaacccttctactcagatttaaaaaaaaatgtgtgtgtgtttatgcatgctatgtgcttatgtaatatattaaatgcaaatatgtattagtacatataaaacttcctaattaacaccaacaaagccttcaagagtaaaactgaggggtatggtgaacattttgaaactaattatgaccctctactaaaatattgccaattcattctccctgaggggaaaaaaatacacacttgtttttcgtcttgtgcattaatagtctaagaaattgacctattgagtagaaatcaaaggaagtttatatctgcccagtaatttctggatttgagaatcagttattcaagctttaacccatgtttctactgacttgatagagtcaaattgacttcaaaattaatttaaccccgaagacactatgtttcagacctctatctaaaatacatatataaagaaatacacaaattaaaaccgttgcttccttttggtggagtggatcttccagagcctgggggatgtttgtacctcctctctcttggctgtcacaccttgagcatttgagtttacagattccatagaatcacttaggtcctctaagttaccaatattattatacagtttcctacaaagtagaagtggtccagattatcatgagaaatgccctcaaattttaaagccaaaatatgacacagcacgcatattattttacttattttagagacagggtttctctctgttgccccggctggaatgcagtggtgcaattatagctcactatagccttaacctcctgggctccagtggtcctcccacctcagcctactgagtagctggaaatacaagtgcacaccactgtacctggctaatatatatctatggcatgagctactgtatctggcccgccatgcatagtaagattaaaaaatttttaaaaatccacaccaagcatatgttacaacctaatctctgaacagttctactgcttccatcttctccatgattttccttcaaaaacttttgattagatcaggatttttacactgaactgcttatccaaaagaaataaatggaagtacataaaaatgattacagtaaaatcaatgatttactttataaatagctatcatatatacatttacatcaaatttatattaaatgtattatagtatatgatagctatttataaagtaaattattgatttaatataagtgtgttatatatgatagttatatataaataaaagagaatagagtccatatttacacaaaactttgaaataattatagtccttctgtcattctcctagcttatttatgtagtacatctgagttgtagagaattggaaaaatcatgaatcattcaaataattgtgaatggtaattgaacagttttccttgcaatattcttgaattgcattgatcccagagtccaagagaagactgacaggagcttgatgccatgcaacacaaagcttaagtcatcaaaagtacatgtatttcaaataattttcatctaaaagaacatcacataaacacaaatgcaacagattctaaaactatgatctaaatcagaaaaggtaaatcattttaaaaatgaatacgtttctatttatctgcccacttatatatttatttttaagcaaaatgaatatataaagactaccaggtaattcttccgtaatatttgaaaaataaatccctaaataaacatccctggattttgttatgctatctgactaatgtgatgggtgatttgggttgccaacagttattattttctttcttcaattttaacagaacctcgatgttgttcaaagtattgtgggtaggcatatgaatcctccatttggaggaggttgagccctccttagcacttctatgtgatttctaattaagttatgacaatcatggcaattgggtttttttggcaatgattgatttagaaatcggcatgagactcaattctagccaatgaactatataagttctactagaaaaggagggtgttttgggcattgttgggtgacgtctggatctgctaaagctgtcttgcacccatagggctgaagccaacatacccatggtggcagagtggtaagatggaaaaaacagaacctagatgaatgtcattatgctgctgaattaaccaacactagaatttcccttcctccaggcttttaatttatatttaagaacattttagctgggttttctggtttctcgtactgacttatgttaaatcatataatccatgcctattttaaatatgcactttccttcagtgtaccagttacacctgttaatgatagtctttatattgcaaaatcactgtagttgttatgctgcatagcaatagcaaaagtgatatatatgccttttccccaacagctatgttaggcccccaaaccaccttaggaaatatcagtagattaataaaattaaccagtgcattggttatctttatgcatttagcacagaaatcctcctacagggagagagagtatttagagaagtatataaacattattttatttgagtgcaagagatatgaaatccatttactatgaaagaaacaaaccagactacatccttgcaaaatcattcctatttatttttcaatagcattctacttaagctccaaagattgtgcattaggagaaaacagtgagtatatcagagaagagcagatccaacctattagcactctgataagcaaagcaaattactgaggacaattacccaggaacttttatattctgcaagccttgttcttgtgattcataaaactcttcctggttgcttgtacaaagtcacttcacaatgactatcagtgtcagttggggaaaaaaagttttgttctattttacccttctcagtgtaacatgtaatttacacgcagtacatgttaccttagattgatgctagtggctcttggtaggaccttgaagaagtcactagctgatgaaggtcagtgttgattttggtggctgacaaattattttgtgggatgagcaacaaagtcacattcattttaaggtaagcattagtatagcatgacaatgtcattagctcatgggtttacagaaataaaagtggcccctttttatgtttgacatgtgcaagagaacttaaatacagcaatatgtcattactttcctaattcgttcaaccaatacttttgaagctgcctttataacaatattacagagtaataaataccgtagctagaagacactcttttccatggtctttgtaagtgggaaaatggaagcccaatgagataaagaaatttacactagtacaggtatttagtgtcagcaacagaactcaattctgaatctcttaacatctaggccaccactctttcaactacatcatgatacttagataatataaaaatcctccaaaaaactgcctgtgtttaattaaaccaagaaaaagcatgagtttcaaacgataaaaatatacattttttccaaccagccctggtaatcagacacattcatgaagaccactaatgagaacgaattgtatgaaacacagggaagacatcacataaaataacagggcccatgagggaaaagaataaagtctgaagtgctgatagaaacttagtgatcaatccttggttccattttagcttctgccagtggctggcagcctatattatgacatcaaaagagttatcagtgatgctcattgatggaagctcttttaataaataaatagcatccactagtagccccacagaatatattatggtacaatttagtggttataaagtattttgttgaattattttaggccacccttggaaaaatatttattgaaaatatttatagaaagaaccttacttgtgtctagtcaagaccctttgctagcagatggggaaagtgagaatcagactgaagtgactgacccagggagcctggaagcaattgataggattcaaattctggttttctgaactctttgtccaaattgattctgtcctgaatttgaccaggtaagattcatgggcttgttacgaaggcagtccaggccttctgaatatgcaggtgtatgtgttcatagtgcaggccatttattcagcatttccatatgcctgacactggtggagaatgcaatgcacagatgaataaagcatgcctactttccaagagcttatgtgacacaaggaaggcagacaaacatatttcattgtcatgtgttaaatattgtgacagtgcagagatacaaaagattactaaaaggacaacttttaaaagccatctctcttgtacatgtcaaaaatgtcatcaaaatgccactttctggtactacctatttagacctttgaaatgcaaatatttcagcacagaagcccagagtccttggggaggaggtggatggtctgcctgcttcactaaaaggggagtggtagaaaaggggctgaaaggactaaaaaagctgaacttgagttaatttaccttcctgtcagtgatctcaagtttgtctcataggaaggttttgcatgccaaaaatggttcttttgtttaatctcaatagggaaaaactgtgcaggttttagtttattctgtatgccaggccatgcatttagagaacttcttatgcacacacacataagtaataattactcttcaaaatttggcaaatgtccaaaatgtagcaatttcccatacctggaaggtatgtaattttttagcaaaatctttttttaataaatctgaattaaaatgttttgccaagcatagagcctccaaggctataagagataatgtgtcaacggtccctgcatcgaaaatgaaagtttcatcctacatgagaagctcatttatcttctgtgcagttactctctaaaatcttatcttatatttaaattcaatgtaacttggggggaaaaaaa

SEQ ID NO: 484 - DNA, 1684 bp, Homo sapiens
acccccatccggatattaagtgttttgcatgttcagactcatgttaggtttaatttaaagagctagtggttaggcactccatagaataagtgtgaaacaatagtcatttacgtgaattaaatgtttgacattagaagtgttttgagcctagaaacagacacataaatgatcgtagttaatggaaatactgccatgcttaagatcattcagcacttctccagaatgcaaagtatatttagaattagatgcagatttacatgtgaataaaagattttctccagccttactctccaacatccagagtaacaacagaacagcaatgagaaagagaaagtgacatgaaaataatttgaaggcaaaaagcaagaatgagaaatgttcatgctcaggtaaattctgagaacaaggtagtgctataaagaggggaaagaatagaaagaagtattaattaatagtcactaaaaattaaaaagctgtcccacttgaaagtattaactgggttattaagagaaaagaggaaaaattactgtggactgtgcggtgtggatctgggacaaaaggtagtataggaaagcataatttatggaatagaaagctatatggagttttaaaaataagcagtaattttgaccaccaaaatagagatgattatactcttaagaggaaaatgttgagttgtagccatagtggggttctgttacagcaaaagtacaagacaatggaatatgcagctattaaaaattagaagagacaaggccaattttctgtagtactggaaggttttggtattcactaaaattaaagatttaaacaaaaggaaagtcatcaaatgtcttttacccttagaatgcaccagtatggatacagttctggaaatgtactgtacaggcatgagttcaagtcctctgatgggccagatggatttttatctcctcatccaggagcaggagggccagcacatttcttgcttttaatgatctgaggcttccaatgttttccttttgtctttctctagcatctctggcttgttcttgagcctatttactcttgtttcatcttcctgttatttatatatattcatagcaaacattcttctgcattcattttaggaacaaaagcttatgatggtatataaaattcttatctttaccttccttctctctatattgaaaaataattcctttaccttttattcttagaaatactatttcactactctagtattcagaacatacctcaatttctccaggttaagtttctgaagttcagcaaactacatggaattccaataattcaaagtagaataaccatatggtttcacaacacactgttattgttttttgtttatctcttttgaaaaactttaaactgtggattgcttcatcttttggtaagctaaactcacagatattattgtttaatatgtacacttgatcaacttttcccatattgcatttctattgaaaatttattttgctaaggttatcaagctagttctccaatttgttagtcaattatatttttggttttgacaagtaagaaagcttttattgaattttcttattacacatgcatttatattatttaaaaatacatattcatagaaaaaagaaaacatagaaaaccgtaagagtcactcaaaatatctcaacttgcagataaccattgttaacattctgctatg

SEQ ID NO: 485 - DNA, 5609 bp, Homo sapiens
taggctttatttgactgcatcccacatcttgtttcgtaattttcttaggatttaaggcagaacctaatgttcaaactcactggtaatcacggaaacacaaattacaacagtaagaaatgatcaaataacgtgagattcatcgaaatagcagaaataggaaagtcaatattaccaactgtgactaaagataggaggaattaagtactcttacgtccttgtaaagttgtgcagccattctggatcagattggaaggacttgggaaaataagttttttttgttttgttttgttttggttttttttgccttaagacacaatacactctctcctgaatatcccagagatattctcacaacatccatcagcagacacaaatgggaatgttttccatggtctcctatgtgggaatggggagttggcgaccaccccagggtccatcaggggagaggaattgtgaaatatactggaaacacactgcagaatagtgtgcggcagagagagacaacacggggagatcttacacacataacattaaaagaagaaagaaaatacaaaatattttctaccacagtactacttttgtaaatttaagacatatacacataaaacattacatattggtacattttaagacataattaactcaatctgaggtccaaactaaagcagctaatgacagacagatgtggacatacagaatctagcaatgtcatgtgaaagtcataggcagttttctgtctcgtctcttaaaaggcatacttttctttctttctttctttttttttttttttgagacagagtgcccaggcctgagtgcagtggcatgatctcagctcactgcaacctctgcctcctgggttcaagcaattctgccacaggtaattcttctgctgcagcctctcaagtagctgggactataggtgtgcatcaccacatcacttggctaattttttgcatttttagtagagacaaggtttcaccatgttggccaggctggcctcgaactcctgacctcaagcaatccacccgcctcagcctcccaaagttctgggattacagctgtgagcccctgcacccggcccttaagtgggtttacttttgactaaagataacattacttatcctttaattaaatccaaaagtgagcaatgaaacagtgagcggagttgttaaaaagattttcaggtgttctgttgaacctgaatgcatttccatttgagcacttgcatttatctctgaaaacatagccaccagggagctttagaacatctgctatcaaaaccatcaaaactgaaagcctttctattccatctcctacaattatattgaaatggattgttgaccattattttctatcttcaacacatttattttcatcagcgatttcccaccagcacagcagtatgacatttaatggaatagctattgtgaaataattatgtttaccattataattctaggtctgcactgattttaatcaaactattccaaatagctttttgatcatagttattatatacaatttagaataatctgatcaggttggaatagcttctcctaattaaacaagtgtgtacataaaaggtgtatatgaatggctgtttacattttaaggaataaaagaaaatcagacttacgaatgtcttattaaaatgaacaataatttggattgtgttaaatcagttctctataacatgtgtgcatttaagtatgtatatatattatagaagtgtgtatatgtatcatagaagactaaatatatggtaaagatttctatagagcataatatgtaaagtaagagacttatatagaaatggaaattcagaaggtaaaatttcccaaggaaaaatattcattctaatatatcaatcatgatttactaagttgcaaatctttttaaaacagtcccaacattttagatcaattgttaaccgacaattggcttacacgaggtggattaattagttactagcttcatttgtgctttccaaaagcatgttttagcttttatttgtcatacaacagagttaagcatgggctaccttgtttagaattccctcgttgctgcatgtggaggttaatactcatgtcatgagcaccaaaagtctggtcagtgtgcatggggaatggactattaacattgtttcttccctgctgtttcttctaggaaaactgacacgcttcacttttcttgatctctttctacaaaacacacaaattaagcaaatatctgaacacaccaacaaacaaaagcaataaacaaacacttcattttgtcatctttatttttatgtagtgtttattacattaaaacacatatgttatatgtatgtcttgaacaaggcactgggctagacactgagtattgaacagacaaataagttatagtccctgcctgtaagaagactaaaatctcttcagaaaagtgcaggtgtcatgcattctaatgaaggacatggtaggaaaaaagcctgtgagagagaagtgtgttcagtcaggctctaggttatttcagtcccgtctttcatggctccttattcttcccattgcttaggaaaaaaaatccctaagcagtgttgcttgaccagacctgtgtgcttgtccccaatatgctcaagagaatgatacaggtacttttctgcccaccttgagataatcaattgtcctgaatggaaaatcagtgctatgattggcagccccatacaggcaagcatgtatgttatacctccacgggaatcagtaatgaaagtaatgatgggcatcaaatattatgtagcctgtcttagcatttgtgcctttgcacacaatagagttaatatgaatcattttggtgtagaaattgtgagaacaaggtcactgtgtaaactgacaaagagctttcctctcaagtgacaagttggactaattgcctggggccccatgctgaaactcaacaatataatgaccagcgtgttccttatagtgactgatatggcatctgagatggaggaattcaaaattgagtatttgttcgttatcattttacaaagtagcttaaattaaggattttttaattaaacaacaaaaatctctgttgatacaaatgtttcctggtcccttctagattcttaaaccaaactttttcaatgtagcctcgggccaaatttctttgaactaaaaatcagccaggttcagtggctcatgcctataatcccagcaatctgggaggccgaagtagagggattgcttgagtctaggagttcaagaccagtctgggtaacatagggagaccccgtgtccacacacacacacacacacacacacacacacacacacacacacaaatccgcgtggtggtgtgcaccaataatactagttacttggaaggcggaggcaagaagatgacttaaacccacgacttcaaggctatagtaagctatgatcgcaccatcgcactccagcctgggtgacagagcaagaccctatctcaaacaaacaaacaaagaaaaagacaggataaaagtcacagaaatggtctacacactaggaaaaaatgtgacaattttttcatgaacacagcattgtctcctcttcaaagccctccatgtgccccagctaacatctggtatcaagtcaattacgtggaacaaagtctgcttgcaccatgagaaagctcagcagcatttagtttctacaagccatacgaacaaatagcacatttacaggaatgcaattacaaaaaagctttatctgagttaaacttggaattctcattaaaatttttttaattggttgtttttattacaaatagtacagagttaaaaatgataagatactaggactttggttaacagctctgtaatggagtttataatatttggaaaactgcctgtaaacagaatttctctacatgtgggatttgaagtgcaattgcaatgaaatattgtttgtttttgggacggagtctcgctctattgctcaggctggagtgcagtggcaccacctcagcttactgcaacctctgcctcccagattcaagtgattctcctacctcagcctcccgagtagctgggactacaagcatgcatcaccacgcccggctaatttttgtattttgagtagagatagggtttcgccatgttggccaggatgctctctaaatcctgacctcaagtgatctactcaccttggcctcccaaagtgttgggattatagacatgagccaccacgcccggcccccgttaaattttaaataagaattttgctctaaatctttttacttaatttacatatcttgatgcatttgcttggagagctatattccctaaaagaagtaagatcttcagcagtaatatatcatattgtgacccagaactctttagcttaatgataatgataggattttaaaatttaatgctccattctatgtcattttacaccttaacaataaaaatattattcatatctagaatgcaaacactgatagttgatatttatcgtgaacttattagatgccaagtactagtttaccaattatatgtgttttaaatcttggaacccttacagcaatcctgtgaagtaagtgttatcatcataattattacctgtgttttagagatgaggaaactgaggcatggaaagtttagagggcatgtccaagatcacacgttaagtggcagagccaccgactggactcaggtagtcttattacacatttgagctcatgcctcccataacaacaacaacaaatcaacagaaaataatcagctccaacacacccacagcattgcttagaaaatgggctccctgattcaaatggctttaattgcaaaaggcactatagcaaccacaatgatcctcttggaagagttagttcttctaggatcaacataggcagcaagcctagctgtaaagcagcccacagattaaataaattctatgggaaaaaaaaaaaaaaaacctgagactgataaagttagtccataggtttgaaccatgaaataatccaaagtaagtatgactgatctgaatatggaaatgtactgtgttcagttagcaaaataaaagtggcatattcttctccatgtttatcttaactagctcatatgtatttgatgtatgccagataaaaagaaaacaatgatccagagctatgccctgcctctctcccatacttggctaatggaccagtcatggagtttttatcaagacggggagaaaacctgggacattagattacttagtcgaacaatatttacgaactttgtgacagtgataagagcctgaaactaggccatactgctctttatattttagaaacagcaatgaggtcacttttaaactatgctaaagtttggctactaatgtggtgtggttgcttcattatgctcttaaacagccacaccagccattccttcagcactgtctattgggcactctataaaaatcccaacttttgtttttccagtgatcacaatatattcatgctgaagcaacctcatttcagacatctatccctcttggcaaccaaaacaagataactgacaaggattaaaagccaaaatttatgactaaatagtgtttattgactttgcacaactaactgcaaacttatctcatagagatatactc

SEQ ID NO: 486 - DNA, 5217 bp, Homo sapiens
cgaaaagtcaattaaattaatatactcaacaaaaattaattgagttggggtgtggggacattgcaagaatgctgcagtgaaaggcttccaaatatctgctcctccacaatggcaatgaaaacactaaatcaacattttaagaactctgtcaactaaccaacagagaaattcaaagattctttattaaagaaaaaacagctgaatctcaatgagaacagtgacctttctggtgttttaacttgccctactcccatcctctcttctcagctccacaatagctttgaaaaccaacagcttggtaaatatgatagcagtgacaagcatagccataaaaaaaacagcagcctaccaaccaaaggagagggaaaaacagttttgaagctcctcaaaagtgcccttaccagttgttattatttgatctggctggtagtttcctggaaacctctactagtagggcttgtctttacttgaccggactcagagataactccttgtaaacaacctttccccaggacatcggtcaaaaaccatccatggtaattgcttaatatcagctacctgaggcatctataaaatttgggcaaacaagaagctgaccaaaaccttacatggaaaatgtggtgaatgaattgtccatagggtctgtgtgcttgggctgccacaacaaaataccagagactgatcatttgaacaacataaatttattttctcacagtcctggaggctagaatggtccagcatggtgaagtttttgtaaagcctctttttcaggcttctttctcactgtgagctcctttggttaacatgcagagacagagcaacatctctggtatctcttcttttaagggcactaatcccatcatgagttcccattcacatgatctcatctaaccttatttatccacccgaaagcctcatctctgaatatcatcatattaacatataactttgagtggcacacatatattcagttcatacattctgccctagacccccaagatgtccttctcacatgcaaaatacattaattttatcccaaaagcctcaaaagtcttaacagattccagcatcaattctaaagtacaaagtctcatttaaatagtatctaaatcaaatataagtaagccttatccccaaaatcaaaattattctccagctgtaaacctgtaaaaccatacaagttatgtgcttccaaattacaacagatagtggaataggcatgagatagccattcccattccaaaaggaaaaattaagaaagaaggaaggagagacaggccacaagaatgtctaaaaccaaccaaggcaaattccattagctcttaagtctcaagatatctctttttcatttaatgccatttattctagacctacagggatagtggatcctgcctccaggcttttacacagccctgtctccaaggccccacccccaggctttagtcagaggccatatggcctattgaaactgaggcaatggtcccaccctttgccacaaaggacactgacctgatgatctctgaattgcctttggggtcactacttcattttcttgaaaagcacaaagttagagccaaatagctctctggtctggtcttgcaagatctaaaagtctggcagcctttatttcatctcatttgtttctgaccccttagttcaaattgacagtgtttttgcttgtataattgatctctattcctggcctcttctgagatggctgattcagtccatgagtcattaccacgatctctttatcaaataattgttcaaccacacccttcctgttgtcttcaccacaggcttttttatttatttgcaatagagataggctgaaaactttccaaatcttcaactctggttcctttatgcttaacaatttcttcttcaacttctctctctcctttcacattttaccataaacaggaggaaccaagccactccttcaacaatttgattaggtatctccttagctaattatctaattttatcacttgcaaaatccaaagtcttatctaaatattatctaagtttgtttgtcaaaaatatcaatttcacaaaacactagaacatggttaatccaagtgctatgtcactttataaaaggatcacctttcttccattttccagtaatgtttttcctcattttcatctgggaactcaacagaatggcctttaacatccatattgatatcaacattctcttcacgattatttattatattattatatctctagaaagatagataattccccttagctattctcttttctttctgcgccctcactccaactgccttaaatacttcactgcaattttggctttttctagcatacacctcaaaacttttccatcccctatccattgcccacttctaaagccacttacgcatgtttaggtatttgttgcatcagcaccccacttcctggtaccaaaattagtgtgagtcttcttgggcttccataataaattaccatagactaggtggtttaagcaacagaaacttattttctcacagtcctggagggcagaattatgagacaagcatgccagcagcacactttgccaggttctggtgggagctctccttctctctgtgctctgccatggcctttctttggagcatgcgtgtggaatgagaagcaagctctctggtgtcttcttttgggggcactcatctcatcatgagggatccagtcacatgatctcatctaactgtaattacaacatagacattttgagaacacaataaggactttgaaaagctccaacatgtttctgagaatctagaaggcaacacacatgtgcaggaagttgagacacctgaaaaggtcctaattttttaacttttgctgaccttgagtatctgagcaagcaggacattaatggtaacagagttttcaactgcctaccagtaaattgaaggcatgcacctaacacacatggaactattcaggaaagactgggagagttgctcgttcaagatactaaggaaatgcatgtctagtcattagctgacaattatgttaaccagttactacacatgagaaactatagagttcttacaggaaagtcatgaaacaaagaacaacaataacaaacaggaacaatagcaaactgtgaagaatgggatctggtttccagagttgctacatcatattatctaaaatattcagtttcaaaaaaatcatgatacatgtaaacaaacaggggaatatggccccaaaacaaggggataaaatcagtcatgaatttttttattataatttttgtccctgaaaaagtccatgaattagaattcctagtcaaaaatttgaaataactttaaattataatttaaagccattacaattattttcaaagaccaaaagtaaaccatgaatacacatttaaagaaaaacatgagaatgatatatcagcaaatagataacatcaacttaacatataaattatttaaaaaatcgaaattctagagctctaagatacaataactgaaataaaaaatttgctagggagactttttctatgttacaaaattagccaacttttattgagagcttaaaacatattaaaatacatattaaatacacattaaaatgtattgtaaatgctttatttttctctttttttaatttaattttaatttctgggatacatgtacaggacgtgcaggtttgttacacaggtaaatgtgtgccatggtggtctgctgcacatatcaacccgtcacctaggtattaagccccacatgcattagctatttatcctgatactctccctcccactgcccccctgacaggccccattgtgtgttgttcccctgctagggagacttaattggaaattttacttggcagaataaataatcagtgaacttgaagacaggtcaattgagactatctagtctgtggaatataaagaaaaaataatgaagaaaaatgaacaaagtctccaatgtccctgtgatgctatcaagtgtaccaacatccacataatgaaaactttagaagaagaagtaaaagagaaaaagtagaaaaaatatttgaggaaacagtaaccaaattttcaaaatttcatttgaaaatcattaaactatacatattaaaagaaactcagaatgtatgtaagatcaactaaaattatccatgcccagacatatcataatcgaattgttgtcaacagtaaaagataaagagagaatcttgaacacagtaatagagaagtggctcatcacatacaggggtccttgataagaggaacaattgatttcttatcagaaactatggtttccagaaggcaacgggatgacatactccaagtactgaaagaaaaatactgtcaaataagaattctataattttcagaactattcttcaaaaatgaaaaaaaaagtgaagacattgccatataaacaaatggaaataatttgtcacttataaatctactctataagaaatgctaaacggagttgttcagtctgaaaataaaggacaatagacaataaatagaatccacatgaagaaatattaacagcaccagtagacgtaacaatataaataagcataaaaaatagtatgaatatacccttggtttgtaattttttccctgtttatttaaaaggtaactatacaaatcaacaactataaaatggtgctgatggacttataatctgtaaatatttattcttatataagagcacaaagaaagggggaaaagtagagctatgtagcagcaaaattttatataccactgacattaaattggtattgatccaaactaaattgttaagatactagttataatcctcagagcaaccattaagaaaagaatgtaaaaatacaattaaagaaatattaatattaatggaattaaaatgttatactagaaaacatctatttagcataaaagaagaaaataatggaaaaagagagaaacaaacaaacaaaaaaagacatatagaacacatgtgcctggacaacatggtgaaaccccatctgtacaaaaaatacaaaaattagttgagcatggtggccaattggaggctgaggctggtggatcacttaagcccaggaagcagaggttgcagtgagccaagatcacaccactgcatacaagcctgggtgacgcagtgagacccagtctcaaaaaaaaaaaaaaaaaactcaaatcaaaacaacagtaaaaaaaacccacatgtggcaaaatggcagatgtaaagc

SEQ ID NO: 487 - DNA, 16315 bp, Homo sapiens
gatactctataaaatagcatgaaagatatcaaattcaagaaataagttgtaaaaaaaatgtataagatataaaacttctttgagtgacatcagcaagctggccaactaaaagctcctagcacttttctccaccacaagaaaaggcacacacacaaaaaacacattttgaaccaaaataactacaggagagcaatgagaacagcaaggtagccacagaaattctatagggcacaaaaagccagaatggctgcacagggaaggaaaggaatcaccttgcctccaccatctcatccccccagttggggtcagccctacccacctagggacaagctacttcagtcactgcatatccccatctcagtcactgctatatcctccccttaagaccaagctgaagggatgccccactcccaggaacccagagccttgaagtgctagaacagtctcacaacagttgccacagacaagacaatacccaccccccaccgcaggtacctcaggcctctggcctactggagaatttatgcctctggagccagagcagatgtggcaccctaccacctgggtacctcagacctcctacataccagagaagtggcaccccgcatggcacagccgaggtagtgctctgtcacacagggacctctggcctcctacacaccagagaagtctccttcaacaccatgccattggtgaggcagcagcccctcccccagcagggaccctggtcctccagcatattagagcagctgcaccttccagcacacaggtgacatgacaccatatacccaggaatccagaggctctactgactcacgtagctgcacttttagcagtgcctcacatcccagggaataagagccatggctgagctgtgccactccaccctccatgcccaagaaccagaaaacaccccatctacctgaaactagattagccctctactgtctaagctactcaggcacctcacctcttcaaggaatggagtcatctctgtgcttctctccaccacttgagatccaagccacagtggtatattaccattcctcagtccttgctgctgttgcacctggcctcttaaaacttaggttactaccatatcccaccatcttagagtacagagtcaccactgcatggttcctcataacctggagtccagccttctactgtgccctgttggttctaggtcccaaattgcagttgtgcccaaccccagggcctgagcctctggagcaccccttcctcgttggagccatacaagtgtggtgcctgctcccatgggtaagaaccacagctgcttcccaaccccctgggcctgagctaccaggttgtcccttagagcaacaaaccttagcttactggaagaactgcatccactcatgccttggagagtgattctgtgcctcaagtcccaggtgctacaagtttcagaagacaatgtgtgcaagagtctgacctcacgaccactctgagcatctgtgttgtggatcccagtgccactgtagctgcctgtgaaccacgtcagatccaacttcaagagagatcctctcagctaagaatccccactctaaggaagacaaaaacaggagaatccctaaaatccttgctctaataacctacacagtcactgtcactaccacaaattccttcagcctagaccactgaggctctgcaggtatcactaacattgatcacaactgaaaaaacttcacagagactacaacactgcactaacaaagaagcagagccaccacactctgccatgccaggaccctcaggcccatctgcagctaaatgttttcccttataaaagccactctgtgaagtttggaaggagtgaccgtaccaccagataggcagaaattaacacagggacacacaaaaaaatgataaagcaaggaaatatgacaccaccaaaggaccacaataattatatagtaattgatcccaaagaaacaaaaatttataaattgccccaaaggaatttcaaaataatactctaaaaactccaatgagatgcaagaaaatacaaatagacaattcagtaaaaacaggaaaacaactcatgatctgaatgagaaattcagcaaagagatacatgttattaaaaaaagaaccaatcataaatcttggagctgaagaattcaatcaatgagacaagaataaaattgagagctgcaacagcagactagatcaaacagaagagacagtttgtgaatttgaagatgagtattttgaaatgactcaaccagaggggaaaaaagaacgaaaaagagtaaagacttataaaaaaccatcaagcaaacaaatgttcacattatgggaatttcataaagagaaaagacaaagaaaacaatgtttacttaatgaaataattgctgaaaaccccccaagtcttggaaaagatacagatatccagatctacgaagctcaaatgttcccagattcaactcaaagagatcctcttcaagtcatattctaatcacgctgtcaaaaatcaaagacaattaagagtagtaagaatatcaaaatttcttacactcttccaaaaaatggagctagaataactacatcaaaacacattttatgaaggattatcactttgaaacctaagccagataaagacatcacaagagaagaaagctatgacaatctttctgatgaacactgatggaaatcttcaataaaatatttgcaaaccaaagccaacaacacatcaaaaaaattatacaacatgaccagataagatttattcctggcatgcaaggctgattaaacatatgcaaattgatgtcatacatcatattaacaggacaaaagataaaaaccacattataatctcaactgataagaaaaaaaaaagcatttatcgaagtccaacatactttcttgataaaaactgtcaacagtttaggcatataaggaaagttcctcaacataataaaagccatttatgaaaagcccatggtggacattataaaaatgaagaaaaactgaaagcttttccattacaatccagaacaaggcaaggatgccccctccttctattcaacatactactaaaagtaacagcaagaacaatcagacaaaaaaagaaataaaatgcatccaatttgaaaagaagtaaagttatctctatttgcagaggaaatggtcctacacatcaaaaaccccaaagattccacacaaaaaaactattaaaaataataaggttcattgggaggccaaggtgggcggatcacgaggtcaggagatcaagaccatcctggctaacacagtgaaaccccctctctactaaaaaaaaaaaatacaaaaaattagccgggcatggtggtgggcgcctgtagtcccagctactcgggaggctgaggcaggagaatggcgtgaatctcggaggtggaggttgcagtgagtcaagatctcgccactgcactccagcctgggcgacagagcaagactccatctcaaaaataataataataataataataataataataataataataataatttcagtaaaggatacaaaatcaacacatagaaattactacatttttatacacaattatgtaactgaaaaagaaatcaggaaaacagttccatttatgatagcattaaaaaaaaaactgaagcaagaataaaccaaacccaaaatgagtagaaaaaataataaagatcagagtagaaataaatgaaattgaaattaagaaaatacaaaagatcaatgaaatgaaaagttggttttttgaaaagataaataaaattgacaaacctttagtcaaactaagaaaaaaatagagaagatccaaataaataaaatcagaggtgaaaatggagacattacaactgctactgcagaaattcaaaggatcattagtggctactatgagtaactatatgccaatatattggaaaatctaaaacacatctagaagaaaactcctagacagacacaacctacaaagattgaaccatgagaaaatccaaaagctaaacagaccaataacaagtaaagagataaaagacgtaacatgtcttctagcaaagaaaaccctgaaacccaatggcttcattattgaattctagcaaacatttaaagaactaatacttaccctattcaacctattcaaaaaaatagagtaagaagagtaatagagtaatattggccattttacaagagcagtattatcttaataccaaaaccagataaagacacatcaagaaaggaaactacaagccaatatccttgatgaatactgatgcaaaaaccctcaacaaaatactagcaagatgaattcaataacacattgaaaaaaggtcatcaataccaagtgggatttagcccagaaatgcaaggatggcttaacacatgcaaattaatcaatgagatacatcatataaacagaatgcaggacaaaactatataaaaaccttcaaaaaactgagtaaccaaggaatatacctcaacataagaaaagccatatacaacagactcacagcaactatcatcccaaatgaggaaacactgaaagcctttcctctaagatctggaacaagacaagaatgcccactttcaccaccgttactcaacatagcactagaagtcctagctagaataataagacaagataaagaaagggcatccaaacaagcacaggcaatcagagcaaaaatgaacaaacggtatcacatcaagttaaaaagcttctgtacagcaaaggaaacaatcaacaaaatgaagagacaacccacagaatgacaaaaaatattcatctgacaataaattaataatcagaatatataagaagatcaaacaactctatcagaaaaaaaaatctcataatccaatttaaaatgggaaaaatagctcaatagacatttctcaaaagaaggcatacaaatggcaagcaggcatacaaaaaggtcatcactgatcatcagagaaatacaaatcaaaactacaaggagatatcatcttaccccagttaaaatgatttatatccaaaagacagacaataacaaatgctggtgagggtatggaaaaaaagagaaccctcctacactgttcgtgggaatgtaaattagtacaagtactatggagaatggtatgaagggtcctcaaaaaactaaaaacagagctaccacatgatccagcaattccactgctaggtataaacccaaaacaaaggtaatcagtgtatcagacatctgcattcccatgtttgttgcagcactattcacaatagccaaaatttggaagtaatctaagtgtccatcaacagatgaatggataaagaaaatgtacttatacacaacggagtactattcagccatcaaaacaatgggattctgtcatttccaacaacatggatggaactggaggtcaaattagccaacacagagaggcaaacatcacatgttctcacttatttgtgggatctaaaaataaaaacaattgatctcatggagataaagagtacaaggatggttaccagaggctgaaagggtagtgggaggatgggtaagaggaagggaagtttaatgggtataaaaaaatacagtgaataagacctggtgtttgatagcacaaaaaggtgactaaggtcaataagaatttaattgtacattttaaaataactaaaagagtataattggattgtttgtaacactaaggataaacacttgaggtaatggatactccatttactctgatgtgattattacacattgcatgcctatatcaaaacatctcatgtacctgtaagtatatacatgcctactacctacccgcaaaattttaaataaaaaattttttaaaataaaatagaataaaggctgaatctttgagagtgggaaaaaacaaaataaagggcatccaaattgaaaaggaagaagtcaaattaattatctttgtttgcagatgatatgatcatctatttgaaaaaaacctaaagactccatcaaaaaactgctagaactgataaactcagtaaagttgcaggatacaaaatcaacatacaaaactcagtagcatttctatatgtcaacagcaaacaaactggaaaataaatcaagaaggtaatccaatttacaatagctaaagataaaaattaaatacttaggaattaaccaaaaaagtgaaagatctctacagtgaaaactatataagattgatgcaaggaattaaagagaaaccattaaaaaatggaaagatattctatgttaatagactagaagaatcaatattgttaaaatgtccatactacccaaagcaatctacagattcaatgcaataccaatgacattcttcactgaaatagaaaaaaaatcctaaaattaatattgaattacaaaagacccataatattcaaagctatcctgagcaaaaagaacaaaactggaggaaccacatcacctgacttcaaattatactacacagctatagtaaccaaaacagcatagaactggcatagaaacagaaacatagaccaatgaaacagaatacaaaacccagaagcacatccatacaatcacagcaaactcattctagaccaagttgcaaagaacttgtattgggaaaaggaacatctcttaaatggtgctgggaaaactggatattcatatgcagaagtatgaaactagatccctatctcttaacatatacaaaaatcaaatcacatagattaaagacttaaatctaagacctcacactatgaaactattacaaagaaacactggggaccaaactccccaggacattggagtaagcaaagatttcttgagtaataatccaaaaagcacaggcagccaaagcagaaacggacaaatgggatcacatcaagttaaaaagcttgcacacagcgaagttagcaatcatcaaaatgaagagacgacccagaaaatgacagaaaattttgcaaactatcaacctgacaagggattaataaccattatacagagagctgtcaagatggctgaataagaacagctccagtcggcaactcccagaaaggccaacacagaaggtgggagagttcttcatttccaactgaggtatcaagttcatctcattgggactggctagacagtgggtgcagcccacagtggatgagcagaagtagggtggggcattgcctcaccggggaagtgcaagggactggcgaactccctcccctagccaagggaagccgtgagggactgtgctgtgagggactgtgctatccggcccagacactatgcttttcccatggtttttgcagcccacagaccaggagattctcttgtgtgccttcaccaccagggccctgggtttcaagcacaaaactgggcagctgtttgggcagacaccgagctagctgctggagtttttcttttgtagcccagtggtgcctggaaccccagcgagacagaactgttcactcccttaaaagggggctgaagccagggagccaagtggtctcactcagcgggtcccactcccacaaagcccagcaagctaagaaccactggcttgaaattcttgctgccagcatagcagtctgaagtcgaacttggtggtgggaggggcatcgccattactgaggctagagtaggcagttttcccctcatagtgttaaccttgactgtgagtaacaccacagcaaggcaaagtacctggggccagactgcctctctagattcctcctcactgggcaggacatctctgaaagaaaggcagcagccccagtcagcggcttatagataaaactcccatctccctgagacacagcacctggggaaaggggtggctgtgggcacagcttcagcagacttaaacgttcctgcctgctggctctgaagagagcagcatatctcctagaaaagcactcgagctctgctaagggacagactgcctcctcaagtggatgcctgacccccgtgccctctgactgggagtcacctctcagcaggggtcaacagacacctcatacaggagagctccggctggcatcaggtgggtatccctctggaacgaagtttccagaggaagaagcaggcaacaatatttgctgttctgcagcctctgctggtgatacccaggcaaatagggtctagagtggacctccagcaaactccagcagacctgcagaagaggggtctgactgtgagaaggaaaactaacaaacagaaagcagtaacatcaacataacaaaaaggatgcccacagaaaagccccatccaaaggccatcagcatcaaagatcaaaggtagataaatccatgaagatgaggaaaaaccagtgcaaaaatactgaaaattccaaaaaccagaatgactcttgtcctccaaatgatcgcaactcctctccagcaacggcaccaaattggacagagaatgtgtttgacaaattgacggaagtaggcttcagaaggtgggtaacaacaaattcctctaagctaaaggagaatgttctaacccaatgcaaggaagctaagaaccttgataaaaggttataggaactgcttactagaataaccagtttagagaagaacataaatgacctggtggagctgaagaacacagcatgagaacttcgcgaagcatagacaactatcaatagccaaatcaatcaagcggaagaaaggatatcagagattgaagatcaactaaataaaataaagcatgaagacaagattagagaaaaaagagtgaaaaggaacaaacaaagcctccaaggaatatgggactatgtgaaaagaccaaacctatgtttcattggtgtacctgaaagtgatggggagaatgaaaccaagttgggaaacactcttcaggatattatccaggagaacttccccaacctagcaagacaggccaacattcagattcagaaaatacagagaacaccactaagatactcctcgagaagagcaaccccaagacacaaaattgtcagattctccaaggttgaaatgaaggaaaaaatgttaagagcagccagagagaaaggtcaagttacctgcaaagggaagcccatcagactacagcagatctctcagcagaaaccctacaagccaaaagagagtgggggccaatattcaacattcttaaagaaaagaattttcaatccagaatttcatatccagccaaactaagcttcataactgaaggagaaataaaatcctttacaaacaagcaaatgctgagggattttgtcaccaacaggtctgccttgcaagagctcctgaaggaagcactaaatatggaaaggaaaaaccagtaccagccactgcaaaaacataccaaattgtaaagaccattgacaataggaagaaaccgcattaactaacgggcaaaataaccagctagcatcataatgacaggatcaaattcacacataacaatattaaccttaaatgtaaatgggctaaatgccccaattaaaagacacagactggcaaattggaaaaagagtcaagacccactggtgtactgtattcaggagacccatctcacatgcaaagacacacataggctcaaaataaagggatgaaggaatatttactaagcaaatggaaagcaaaaaataaagcaagggttgcaatcctagtctctgataaaacagactttaaaacaaaaagatcaaaaaagacaaagggcattacataaaggtaaaggaatcaatgcaacaagaagagctaactaccctaaatatatatgcgcccaatacaggagcatccagattcataaagcaagtacttagagatctacaaagagacttggattcccacacaataatagtgggagactttaacatcccactgtctacattagacagatcaatgaaacagaaaattaacaaggatattcaggacttgaactcagctctggaccaagtagacctaataggtatctacagaactctccaccctaaatcaacagaatatacattcttcttagcactgcatagcacttattataaaattgaccacatcataggaagtgaaacactcctcagcaaatgcaaaagaatggaaatcataacaaacagtctctcagaccacagtgcaatcacattagaactcaggattaagaaattctctcaaaactgcacaactacatggaaactgaacaatctacccctgaatgactactaggtaaataacaaaattaaggcagaaatcaagaagttctttgaaaccaatgagaacaaagacacaacgtaccagaatgtctgggatacagctaaagcagtgtttagagggaaatttaaagtactaaatgcccacatcagaaagtgcaaaagacctaaaatcgataccctaacatcataattaaaagaactagagaagtaagggcaaaagaattcaaaagctaggagaagacaagaaataactaagatcagagcagaactgaaggagatagagacacaaaaaaaccttcgaaaaatcaaggaattcaggagctggttttttgaaaaaattagcaaaacagatagactgctagccagactaataaagaagaaaagagagatgaatcaaatagacacaataagaaatgataaaaggggtatcaccactgatcccacagaaatacacactaccatcagagaatactataaatacctctatgtaaatataccagaaaatctagaagaaatggataaattcctggacacaaacaccctcccaagactaaaccaggaagaagttgaatccctgaatagaccaataacaagtttggaaattgaagcagtaattaatagcctaccaaccaaaaaaagcccaggaccagaccgatttacagtcgaattctaccagaggtacaaagaggagctggtatcattccttctgaaactattccaaacaatagaaaaaagggggactccttcctaactcattttatgaggccagcatcatcctgataccaaaacctggcagaaacacaacaaaaaaagaaaatttcaggccaatatccctgatgaacgttgatgcgaaaatcctcagtaaaatactggcaaaccaaacccagcagcacatcaaaatgcttatccaccacgatcaagttagcttcatcgctggaatgcaaggctggttcaacatacgcaaatcaataaacataatccatcacataaacaaaaccaatgacaaaaaccacatgattatctcaatagatgcagaaaaggcctttgacaaaattcaacagcgcttcatgctaaaaacactcaagaaactaggtattgagggaacatatctcaaaataataagacctatttttgacaaacccatacccatatcatactgaattggcaaaagctggtagcattccctttgaaaaccagcacaagacaaggatgccctctctctccactcctattcaacatagtattggaagttctggccagggcaatcaggcaagagaaataaataaagggcattcaaataggaagagaggaagtcaaattgtctccgtttgcagaggacatgattttatatttagaaaaccccattttctcagccccaaaattccttaagctgataagcaacttcagcaaagtctcaggatacaaaatcaatgggcaaaaatcacaagcattcctatacaccaataatagacaaacagggagccaaatcatgagtgaactcccattcacatgtgctacaaagaaaataaaatacctaggaatacaacttataagggacatgaagaacctcttcaaggagaactacacccactgctcaaggaaataagagaggacacaaacaaatggataaacattccatcctcatggacatgaagaatcaatatcatgaaaatggcaatactgcccaaagtaatttatagattcaatgctattcccatcaagctaccattgactttcttcacagaattagaaaaactactttaaatttcatatggaaccaaaaaagagcctgcatagccaaacaatcctaagcagaaagaacaaagctggaggcatgactctacctgacttcgaactatactacaaggctacagtaaccaaaacagcatggtactggtaccaaaacagatatacagaccaatggaacagaacagaggctgcaggaataacaccacacatctacaaccatctgatctttaacaaatctgacaaaaacaagaaatggagaaaggatttcctatttaataaatggtgctgggaaaactggctaccatatgcagaaaactaaaactgaaccccttccttacaccttatataaaaattaactcaagatggattaaagacttaaacataaatcctaaaatcaaaaaaccctgggagaaaacacagccaatacctttcaggacttaggcatgggtaaagacttcatgactaaaacaccaaaagcaatggcaacaaaagccaaaatagacaaataggatctaattaaactaaagagcttctgcacagtaaaagaagttatcatcagagtgaacaggcaacctacagaatgggagaaaatttttgcaatctatccatctgacaaagagctaatgtccagaatctacaaggaacttaaacatatttacaagaaaaaaacaaacaaccccaccaaaaaactgggcaaaggatatgaacagacacctctcaaaagaaggcatttatgtggtcaacaatcatgtgaaaaaaagctcaccatcactggtcattagagaatgcaaagcaaaaccacagtgagataccatctcacgccagttagaatggtgatcattaaaaggtcaggaaataacagatgctggcaacaatgtggagaaataggaacattttacactgttggtgggagtgtaaattagttcaacctttgtggaagacagtgtggcaattcctcaaggatctagaaccagaaataacatttgacccagcaaccccattactgggtgtatacccaaagaattataaatcattctactataaagacacatgcacatgtatgtttattgcagcactattcacaatagcaaagactgggaaccaacccaaatgcccatcaatgatagactggataaagaaaatgtggcacatatacaccatggaatactatccagtcatttaaaaaaatgagttcttgtcctttgcagggacatggatgaagctggaaaccatcattctcagcaaactaacacaggaacagaaaaccaaacaccatatgttctcactcataagtaggagctgaacaatgagaacacatggacacagagaggagaacatcacacactggggcctgttgcagggtgaggggcaagcagagggagagcattaggacaaatacctaatgcatgcggggcttaaaacctagatgatgggttgatgggtgcagcaaaccaccatggtgcatgtatacctatgtaacaaacctgcatgttctgcacatgtatcacagatcttaaagtttaattaaaaataaaaataaaaacaaaataaccattattcataaggagctcaaacaactctataggaaaagatctaataatcttatttttaaatcggcaaaagaaacaggcatttctcagaaggagacacacaaacggcaaacaggtatacaaaaaggtgctcaagatcaatgagcatcagagaaatgcaaatcaaaactacaatgagacatcacctcaccccagttaaaatagcttttatccaaaagacaggcaataagtaacaaatgttggcaagggtgtggaaaaaagagaactctcccacactgttgatgggaatgtaaattagtgtaagcactattttgagaacagtatggaggatcctcaaaaaactaaaaacagagctaccacatgatccagcaatcccactgctaggtatatacccaaaacaaaggaagtcagcatattaaaaatatatctgcacccccacatttattgcagcactatccacaatagccaagatttggaaacaatctaagtgtccattgacagaagaataaataaagaaaatgtggtgtttatacacaatggagtactattcagccaaaaaaaagatgaggtcctgtgatttgcaaaaacatgaatagaacttgaggccattatgttaagtgaaataagccaggcacagaaagaaaaacaatacatgtaggagctaaaaattaagacagtcaaattcacagagagtacaaggattgattaccaaaggctgagaaggatagttggaagggtgaggaggagatggaatggttactaggtgcaaaaaaaaaaaaaaaaatagctggaaagaataaataaaaccaagtatttgacagcactaccatagtcaatatgaatttaattgtacattttaaaataactaaaagagtataattgaattgtttgtaacaaagaataaatgcttgaggtgatagatactcccatttaccctgatgtgattattatatattgcatgcctgaataaaaatatttcacgaaatatgtatatttcatgttttaaaaattaaaaaacagctgaagaataaatttaacaaaggtgaaaatcctgtacacagaaaactataagacactgatgaaagaaattgaagacaaaataatgaaaaaataaatgaaaagatattccatcctcatgaatcagaagaattaatattcttaaattatccatactacccaaagcaaaatataggtttgacataatccatatcaaaatcctaatggcattcctcacaggaaaaaaaaaaaatcctaaaatttgtatggaaacataaagaccctaaaacaattccaagaatgaaaaacaaagttggaggaattatacttcctgatttaaaattatataacaaagctatagtaatcaaaacagtgtggtactggcataaaaacagacacatacaccaatagaacagaacagaaaacctagaaacaaacccaaacagatatggtcaactaatttttgacaggggcaccaataggatacaatgaggaaagaagagtctcttcaataaatggtgctaagaaaactggaatttcacacacaaaagaatctgaaccttataccatacataaagataagttcaaaatggataaaagacctaaatgtaagaccaggaactataaaattcctataagagaacatagtggaaaatctcctggacactgacgttggcaatgatttttgcgtatcaaaccaaaagctcaggccacaaaagcaaaaataaataaatggcactacttcaaactaaaaaggctctatacagcaaaagatataatcaacaaaatgaaatagcagcctacaaattgagaaaaatattggcaaacaatatatctgatgaggttaatacccaaaatttacaaagaactcatacaactcaatagtagaaaaacaaataatccaatttttttaaacaggcaaagaatctaaatagacatttctccatagaagacaaaaatcaccaacagctatatcaaaaggtatttaacataattaatcatcagggaaatgcaaatcaaaaccactatgagataccacatcacagctgcaaaggtggctattattttaaaaagtcaaaaaataacaaatgttgacaagagtatacagaaagagtaattaaaaatagaactaccatatgacccagtgatccctctgctgagcatatacccaaaggaaataaaatcatcaccttgtaaagattctgcattcctatgttcattgcatcattactcacaatagccaagatatggaaacaacctaagtgtctgttgatagacaaatgaataaagaaactgtggtacatatatacaatgaaatattactcagccttaaaaaagaatgagatcttttcatttaccacaacatggctaggtctggaggacattatgctaagtgaaataagccagacacagaaagaaaaatattgcatgatctcactaattaaatatggaatctacaaaaagaaatcaaatatacagagagagagaacaaaacagtggttaccagggacagagagggtagaggggatgaaatgggaagatgcaggtcagaggatacaaagtagctgatatgtaggatgaacaagtctagagatctaaagtataacatgagaactacagataataaaactgtactatatatgggattcatgctaagtaagtacattttagctgttcttgccacaaaccaaaacaaaaaaaaaaaatgggtaactgtgaaatgacagatatgttaatttacttcaatgtaataatctttatactatctacatatatcccataacatcatgttgcatagcttaaatgcacaaaataaaatttacaaaacaaaaaaagtatagttacatttaaacttgagttttaggggcaaggaaagggcaaatcagggcagggtggg

SEQ ID NO: 488 - DNA, 59049 bp, Homo sapiens
taaactctgtgcgtaatttcactattttcttgtttaactttatgactgtcctggagagggcagcatcattacctttaatttagagctgggacagggacagtctgtgacacttatcttgatattgaggaatggagtcagtcctccaatggagggaggccgattgaggtgtgatactgagtgccccatcagttgttcaagggctggggcagatctaatattgtgtctgtactggctgatacttaggtggccagggccccagctttggaaacctgtgatggctgctaccacctctggctttgctaggcgcacacatctgcccagactcaatgtattgcaaacccatgcaacctccaggcccacactgagaatcaagaattgtggactcttgattctccaaatcttctcaaaagcccagctgctggctgggtacagtggctcacatctgtaatcccagcactttgggaggacgaggcgggcggatcacttgaggttaggagttcaagatcagcatggccaatgtggtgaaaccccatgtctactaaaaatacaaaaattacctgggcatggtggcaggcacctgtagttccagctacttgggaggctgaggcaggagaatcgcttgaacccgggagacggaggttgcagtgagccgagatcgtaccactgcactccagccttggtgacagggcgagactctctctcaaggcttgagggctgagtgaacactccttaactatttccagttatagccacgggtcgacttagatcaacagaagtctgtatggattactctaatagagtgcaaaaagatctgaactaggacctcattgtgaattcggatcctaccccttaccagctgtgtgaccgtgggcaagacacagaatctctgagctgtcactgccctctctgtaagtgaagtggcacccacttcttatgtctgtgttggtcctcttctcctaattgacactcactcgtttttcgttgttttttttttgagacggagtgtcgctctgtcgcccagactggagtgcagtggcacgatcttggctcactgcaagctccgcctcctgggttcatgcaattctcctgcctcagcctcctgagtagctgggactacaggcgctcgccaccacgcctggctaatttttcgtatttttagtagagacggggtttcaccgtgttagccaggatggtctcgatctcccgacctcgtgatctgcccgcctcagcctcccaaagtgctgggattacaggcgtgagccatggcgcctggccactcttttttttttttttttttttaactttgagatagaatcttgttctgtcacccaggttgaagtgcagtggcataatcctatctcactccaaactcaaactcctgggttacagcaatcctcccacttcagcctcccaagtagctgggaccacaggcacatgcccccctgcctggctaatttttaaaattttaagtagagatagggtctcaccgtgttgcctaggctggtctcaaactcctgggctcaagtgatcctcccaccttggcctccaaaagtgttagggttacaggcatgagccatggtgcctggtgacactcactcttgagttgagctcacacagacccctggctttaaatatcatccaaatgttgatgtcccccaagttttcatcttcactgcagacctcttctgtgagcttcagaactgctcacttgaaacttccccttgggtgtctgacaggcaacacaaacttaacatgtcccaacatgaactttttttttttgagacagaatcttgctctgttgcccaggctggagtgcagtggcctgatcttggctcactgcaaactccgcctcccaggttcaagtgattctcctgcctcagcctcccgagtagctgagattacaggcacgtgccaccacacccggcaaattttttgtatttttagtacagacagggtttcaccctgttggccaagctggtttcaaactcctgagctcaagcgatctgcctgcctctgcctcccaaagtggtaggattacaagtgtgagccaccgtgcccgggcccaaaatgaactctttatcttctcccccatacctgctcctcctgcagccttcccatatcagaatacaacaattctattcttacagttggtgtggccgaaaaccttggtgttgtcctcaatcctctctcacacatccccaaatccaatctgtcaagaaaccctggtgatcacttgagcccaggagtttgagaccaacctgggcagcatagcaagaccctgtctctacaaaaaatacaaaaatcagcggcagggcgcagtggcttacgcctgtaatcccagcactttgggaggctgaggcaggcagatcacaaggtcaagagatcaagacaatcctggccaacatggtgaaaccccgtctctactaaaaatacaaaaattagctgggcatggtggcacgtgcctgtagtctcagctacttgggaggctgaagcaggagaattgcttgaaccagggaggcagaggttgcagtgagccaagatcgtgccactaccctccagcctggtgacagagcaagactctgtatcaaaaaaaaaaaaaaaaaaaaaaaaaaaagctgggcatgatggcacacacctgtggtcccagccactcaggaggctaaggtgggagggtcgcttcagcccagaagttggaggccgcagtgagccataattgcaccagtgtactccagtctgggccacagaataaaactctgtctctagaaaacagaacaaaacaaagttgaagctctctaaactctccacactgactcagagtgaaagtgctaataatgacctaaagccgtgccctatggccccctttcctcttgacttcgcttttcatgcactctgctccagccatactggcctccttgggcttcccagaacacgcgaagcaggacccaggttagggcctttgaactggctttgtttgtccgtgggattccccatgaacatctcatggctgctccctctcttccctcaagtctcccctcagatgtccccttctcagagacatcagcctgtagaaaggagcacttccttcccccactttcctgcgtgatgtttctccatgatgcctgcttcctacatatgtagagtctgtctcactccggagaaggctacctccaagaggacaggtgactggcccttgatttcattaattgtcacaatcctatgccggacacatggttggtgttcaacaaatatttgcggaattaaagaacaaattaataatgttgtgagataaatactctgtgcccatttttctttactttttaatatattttttaaatctagagagacagggtctccctatggtccccaggatggcctcaaaactcctcctgccttggcctccttggctgggattactggactactactgtgccaccatgcctggctcttcttttccttttactatgcccattttaaaggtgaggaaaactgagactcagaaatgttcccaagggcacacagtgagtggtggctgccttcaggttggtctgactccagtgcccaagcctttctcaggagtggtgtgttgcccatcagccattatatccatgacatcaactggcataagatatgttcttatatgaaaattaattttagaagtgagtgtcacgaaatattgaccttctctaaggaactagttcttatagtcaaaaaggaggaacttatgtaaattttccctttcagggccagccccaggaagttcagagcctaatgtggtgttcattctattaattttttcttaccctgggacttttttctttctttcatttatgttaacctaatcaccagctgcttcctgttccttaggaaatagctaagtcgtacatgacacttttggggttccagtgtgcccggcatgggttttctttcattgggcaggcactaggtgggcttttcagcctgaagacgcatgtttctcatcagagtgagaatgatctctgatcattctccttcttccatttcttgggttctctcttcctggcactcctattggttagcttttgggcctcttggattgcctggctgtgtctctgtggcaaagactactcattatccaaaatccaatgagcccttcttccccaagaacatggtggaactgcatgtcccagcctcccttgcagtaggcatggtcatgtgactaagtttccaccaatagaatgtgaggaggtgatgtatgtgacttctggtctttggccttaggaagtaggccagcttcatactctccattcctgctggctggagatccccacaacagattcaaacgtgcaggtgacaaacggtgccctaccgatggcagaaaagtgatgaggaagggcccttggtccctgagcaatgagagaagcagagctgcctccctaactaccaccatttcacttgaacatgtctcttcttttgtttatttatttatttgttttttgcagacacgtctcttcttttttttttttgagatagagtctcactctgtcccaggctggagtgctgtggcacaatctcggctcactgcaacctctgccttctgggttcaagtgattctcctgcttcagcctcccaagtagctgggattacaggcatgcgccaccatgcctggctaatttttgtatttttagtagagacggggttggccaggatggtctcacactactgacctcatgatccacccaccttggcctcccaaagtgctgggattacaggtgtgagcaactgcgcccggccgacacgtctcttctttaagccgccacttattggatctctatgttagagcggcagtctcatatattttctctcatattttcttctccacccctacaccttctgggagttctattttctgggataattaattaattaatcaatttttgagatggggtctcactctgtcccaggctggagtgcagtggagcgatcttggctcactgcaacctctgcctcctgggttcaagctattctcctgcctcagcttcctgtctcaaactcctgacctcgtgatccacctgccttggcctcccaaagtgctgggattacaggcgtgagccaccgcgcccagctttatttattttttaaattttttattcttgagacagagtctcactctgtcacccagggtggagtgcagtggcataatcttggctcatggcaacctccgcctcccgggttcaagcgattttcctgcctcagcctcccaagtagctgggattacagacgcctgccaccacacctggctaatttttgtatttttagtagatggggttttgctacgttggccaggctgatctcgaactcctgacctcaggtgatccgcctgccttggtctcccaaagtgctgggattacaggcatgatccaccacacctggcagttttctgggataatttattaactttttattacaacacttcctgtttgtgtttgtacagatgaggccttgctatattacccaggctggtcttgaacttctggcctcaagccattctccttggcctcccaaactgcaggaattacaggagtgagctactgtgcccagcttctttattctaatgcttttagtaattcagtatcatagctttaatttctaagaattcagtctttgctctatttatttatttatttgagatggagtctcactctgtcgcccaggctggagtgcagtggtgtgatcttggctcactgcaacctcctcctcctgggttcaagcgatcctcctgcctcagctcccagaatagctgggactacaggtgcctgccaccacacccggctaaatttttttttgtatttttagtagagacagggtttcaccttgttggtcaggctggtctcgaactcctgtccttaggtgatccacctgcctcagcctcccaaagtgctgggattacaggcgtgagccactgtgcctggcctctttcttttttataacaccctgtttttattgtaacatagtgtagcaattttttttttctttgagatggagccttgctctgtcgcccagctggagtgcagtagtggatctcggtttaactgcaacgtccgcctcccgggctcaaatgattctcctgcctcagcctcccgagtagctgggattataggcacctgccactgtgcccagctaatttttgtatttttagtagagacagcgattcaccatgttggccaggctggttcgaacccctgaccccaggtgatcagcccacctcggcctccaaaatgctgggattacaggtgtgagccactgcacctggccagcaatatcttttttttttttttttttttttttttggggaaagagtcttgctctgtcgcccaggctggagtgcagtggcgcgatctcggctcactgcaagctccgcctcctgggttcatgccattctcctgcctcagcctcccgagtagctgggactacaggcgcccgccatcacgcctggctaatttttttgtatttttagtagagacggggtttcaccatgttagccagaatggactcgatcttctgatctcatgatccacctgcctctgcctcccaaagtgctgggattacaggcgtgagccaccgtgcctggcccatctttttttttttttttaatatggggtcttgctctgtcacccaggccagagtgcagtggcatgagcacagctcactgcagcctcaaatacccaggctcaagtgatcctcccacctcagcctccagagcagctgaaattacaggcacgtgctaccacgccctgcccagctaatttttttttggaagcagcaccttcatttattagggacttcggtggggatggggaaaggcggcccccgggtcagaggcgccggaagaagagcttggagccgtggtctaacgtgcactcgctggggcccagctggctcccgcccagctctttttttttttttttttttttttttttgagatggagtctcactctgtcgcccagactggagtgcagtggcgcaatcttggctcactgcaacctctgcctcccgggtttaagcgattctcctgcctcagcctcgagtagctgggattacaggcacccgccaccacacctggataatttttgtgtttttagtagagatgaggtttcaccatgttggccaggctggtctcgaactcctgacctcaggtgatccacctgcctcggcctcccaaagtgctgggattacaggcatgagctactgtgcccagccccgcccagctaattttttaattttttgtagagacaggatctcactatgttgccagggctggtttcaaactcctggtctcaagcgatcctcccgctttggcctcccaaagtgctgggattacaggggtgagcctcgtgcctggcctgaagcagcattttctcaaatgtctttaaaaataccagatttttttttttctttttctttttttcttttcttttcttttcttttcttttctttttttttttaagacggaatctcgctctgtcgcccaggcgggagtgcaatggcgcgatctcactgcaagctcactgcaagctccgcctctcgggttcatgccattctcctgcctcagcctcctggtagctgggactacaggcgcccgccaccacgcccggctaattttttttgtatttttagtagagatggggtttcaccatgttagccagaatggactccatctcctaacctcatgatccacctgcctctgcctcccaaagtgctgggattacaggcgtgagcgatcgcacccagcctctttttctttacgtaaattctgtttcctccaggattacttttcttttctttttcttttttttttaaatttttttgaatgtacttaggatgcatttggctacaaataactaaacatccgacttacaggaagctcacagaagggggtggctgggattcagggccccttgatcaggcatttgcgatgccttgggatcccatgctcttcctcccattcctcctctgcaatcctgcaatgtttccatcctggggccagttcctctcagagttacaggatgtatccttaatcatggcttgtgggaggcagaagttactgcccccgggttctcttttaattaaaaggaagaagcctttcttagaagcctcccttccttttatcttagtggctagaactggggcatgtaccctttcctaatgcaatcgtgggcagaaggggagtggttactttagactggtcagactttgctggagctgaagaaggaaggggtcagtgcccaggatgtgtatgctggtgggcacctgaacaaactggggtacttttaggaaagaaggaggcagaatggatgatggggttggtttatcttggtgctttcctttcatgttgcagggtttctttgaatgttgttgatatttcttccaggcgtgacggctcatgcctgtaatcccagcagtttgggaggccgaggtgggtggaatctcttgcgctcaggagttccagaccagcctgggcaatatagggagacctctgtctctacaaaaattagccaggcgtagcggtgtgcacctcccagttttgctgggaggattacttgagcccaggaagttgagttgaggctgtagtgagctgtggtctcaccactgtattccagcctgggtgacagagtaaaaccctgtctcaaaaaaaaaaaaaaaaaaaaggttgatatttctttcaagtcccatcatacttcagagtgagccaataagaggctgactggggcttttggtaccagagtagagctttccaacttgagggttggactttcatatcaagtgtgagaataaactaaagacctatttaggtgcaagattactttgggcacggtggctcacgcctgtaatcccagcactttgggaggctgaggggtgacgatcacctgaggtcagtagttcgagaccagcctggccaacatggcgagaccccgtctctactaaaaatacaaaaattagccaggcatggtggcgcctgcctgtaatcccacctactagggaggctgaggcaggaggatcgcttgaacctgggaggcagagtttgcagtgagccgatattgccccactgcaccccagcctaggtgacagagtgagacaaaaaaaaaaagcaaagttcacctttttattagggagctttctttggatgtgacttgaaaatgtgctcctgcaaaattaagagggtaaatcacaaaagagaagggtgcagactacaggaaataggagatcccacccaagagagaaataaccactggtcccaagatgtagcagtgtagcaacagggagtgggaggggagaaggaaggtcacactggagcaaggaattagtgaagcaattagaaactctaggtaaaattaaaagagatgtattgtagtaaatttactatgatacattatcgtagtaaatatcgctaaaattttatatatatatataaatatatatatttatataatataactgaacaatagttatataatgctttttttttttttctgaggtggcatcttgctctgttgcccaggctggagtacaatggcacgatctcagctcactgcaacctccgcctcctgggttcaagcgatcctcctgcctcagcccccctagtagctgggattacaggcacgcgccaccatgcccagctaatttttttatttttagtagagatggggtttcaccatgttggccaggctggtctcgaactcctgacctcaggtgatccacccgcctcggcctcccaaagtgctgttattacagacgtgagccaccgtgctaggcatttttttttttttttttttagagacatggtctccctttgtcacccaggctgcagtgcagtggtatcatcatagctcactgcagtcttgaacttctgggctcaagtgattgtcccgtctcagcctcctgagtagctgtaagtacaggcatgtgctaccatgcctggctactttttttctttttttctgtacagatggcaccttgctatgttgccccagctggtcttgaactcctgacctcaagtgatcctcctgccttggcctctcaaagtgctgggattacagacatgaggcaccacatccagccccataatcttaaaaacaaagaaaattaatagttttccattttagactcaaactctggaccagacagcactgatcttgactatctgaggtgatagaaatagcctttatctgtgttatttgatttgatagctactagccacatgtggtttctgaacacacttgaaatgtaactagctagttgcaactgagggaactaggttttaaatctcattaaattttaattaagttaaagtagtctcctgtggccagtggcttctacattaggcaatgcagctctaagcaagatgaaagagagaatgccaatattatctacatttaacaacataaaagtaaatgtacaggtaacagaaatgagcagaagagagataaaggaaagccactatcttcatgtcacaaagtgataagaatttaggccagaagctgtggctcatgcctgtaatctcagtacttttggaggccgaggcaaggaggatcgcttgagcccaggaattcaagaccagcctgggcaacataatgagatccctgtctctacaaaaaaaattaaaaattagctgggcatgatggtgcacacctgtagtcccagctactcaggaggctgaggtaggattgcttgggcccaggagttcgagggtgctcatctctttaaaaataagtaaataggtcaggtgaggtggctcatgcctataatcccagcactttgagaggctaaggtggacggattgcttgagcccaggaaattgatctcagcctgggcaacagcgaaacaatgtctctacaataaatataaaaagtaaccaggtgcatgccgggcgcggtggctcacgcctataatcccagcactttgggaggccaaggcagggtggatcacaaggtcaggagatcgagaccatcctggcgaacacggtgaaaccctgtctctactaaaaatacaaaaaattagccgggcatggtggcgggtgcttgtagtcccagctactcgggaggctgaggcaggagaatggcgtgaacctgggaggcggagcttgcagtgagccgagatcgcgccactgcactccagcctgggtgacagagcgagactccgtctcaaaaaaaaaaaagtaaccaggtgcggtggcacacacctgtagttccagctacttggaggctgaggtgggaggatcactggagcccaaggttgcagtaagctgagatcaggccactgcactctagcctgggcgaaagagtgagaccctgtctcaaaacaaaacaacaacaataataaaactcatacataactacgtaaataaagttacaaaagcaactttagttcgttacaaaggacctgaagagagggatttaactgacctgcaaggtggaatggggctggagcagggccagtgggtcagacacctatgattatgccaggcaaaatggatacatgaagaaataaagttatagcatctccatgtagtaatagaaaaaaaaaaggaataacgaaattagcacactttttgggaatgtggacccaccagtagaattgagactagaaaaagttaaaagcattagaagtgttctctttctgagatcatgacttgttggggaaagggaagacttattgttcatgacaaacacttctgtgcttataacatgcattagcttaggaaacagcacttttctttttctctttttttttttttttttttttttttgagacaaggtcttgctctgtcgcccaggctggaatgcatgttgcgatctcggctcactgcaacctctgcctcctgggctcaagcgatccttccaccttggcctcccaaggcgctgggcgctgggattacaggcatgggccaccgtgcccggcctggtgcttttcagtgaataaataagtatgtaaacttctcttttctgactagacggaaattccccagaggacaagggtggcgtgacttgtcagtccttttcattgacagcgctgtggatgggaagaaagggcccctggtcccaagcaagccccagtcctgtggccctggaggatcagaagggtaattaagtgtcaaaggaaaacatagccagacatgagttactgtggtgaaaacagattttattcagtaactactcgtggtaggagaaagagctgagctccattctgatttgtgcagaggtgatttaggcatttaattagttaattagtttttgtgggacagggtctcgatctgttgcccaggcttgtgattgtgcctgttgctcagattgtgcagtggcacaatcatggctcactgcagcctcgaactcccaggctcaagtgatcctcctacctcagcctcctgagttagctgggacccacaggcgtatgccactgcacctggcttttttttttttttttttttttttttgaaacagagtctcgctctgttgcccaggctggaatgcagtggcatgatcttggctcactgcaaccaccacctcctgggttcaagcaattctcctgcctcggtctcctaagtagctgggattacaggcgcgtgccacaatacccagctagttttagtttgttttttatttatttattttttttagtagaaacgacgtttcaccatgttggccaggctggtctcgaactcctgacctcaggtgatccacccacctcggcctcccaaaatgctgggattacaggagtgagccaccgcaccagtgtctctctcttataacaccagctagtccttatcaggctttgactgtgggcccctcacctgtctaacttatccttcccaggaactttgaagaatactattattattcctattttgcaaatgaagaaactgaggcagattaaatgcctgacccaaggccatccagacggcaggcgatgcaggcaggagtcaagctcaggtacccctccccttctgtggcttccctgcctccaggcttctgccagcccctgtctaccttggtgtaggagcggcccctcaaagacctgcagggagccgggcacggtggcgcacgcctataatctcagcactttgggaggctgaggtgggcgtatcatgaaaccctgtctctactaaaaatacagaaattagccgggtgtagtggtgggcacctatgatcccagctactcagaaggctgaggcaggaggaacgcttgagaaccccagaggcggaggttgcagtgagccaagatcgagccactgcactccagcctggacgacagagcgagactccatctcaaaaaaaaaaaaaacctgtagagggaaggaggaactggggcctggggagggcagagctattatctcaggagaagcaggcaaacctctggtgacctctgatgacctcagggcaggatgggcaggccttcacaacagctccaggcacacccagcctcccgtccctggcctcatcactcccctctctgccctccaccctttggcctccttgcctttgtccacagttctgcagcctgataccctcttccttgtctcaaccagagaagtcttcagtcaataaacgtcatccaatgcctactgtgtgtcaagcacttcctgggtgctggggcactgtgcaagcacacacgcacagctgtgaggccatggggctggcattccagtgtggggagagcgacggaagcaaaataagaaagtccattacatggcgcatttgaaggcgcgaagtgctatggggagaaagcaaggaggggggttacagtccagagggaggggggtgcgattttttttttttttccagacggagtcttgctctgtcacccaggctggagtgcagtggcgtgatcttgcaaactccgccgcctgggttcacgccattcttctgcctcagcctcctgagtagctgggactgcaggcacccgccaccatgtccggctaattttttgtatttttagtatagacagggtttcaccgtgttagccaggatggtcttgatctcctgaccttgtgatccacctgcctcagcctcccaaagtgctgggattacaggcatgagccaccgcgcccacccgggggtgagattttaaatacaatggccagctgggctccgtggcacacacctgtaattccagcactttgggagaccgaggtgggaggctcacttgagtctaggagtttgaaacaagcctgggcaacaaagcaagatcccatctgtatgaaaaatttaaaaattaggccgggcatggtggctcatacctgtaatcccagcactttgggaggccgaggagggcagatcacttgagctcaggagtccgagaccagcctggccaacatggtgaaacactgtctctactaaaaatacaaaaaaattgctgggcgtggtggctcacgcttgtaatcccagcactttgggaggccgaggcaggtggatcacctgaggtcaggagttcaagaccagtctggccaacatggtgaaaccctgtctctactaaaaatagaaaattagatgggcttggtggtgggcacctgtattcccagctactcaggaggctgaggcaggagaatagcttaaatccaggaggcggaggttgccgtgagccgagatcgaaccattgtgctccagcctgggcaacgagagtgtgaaactccatctcaaaaataaaaataaaaatacaaaaaattagccgggcatggtggcgcgcacctgtaatcccagctactcgggagactgaggcgggagaattgctggaactcgggaggcggagttgcagtgaaccaagattgtgccactgcactccagcctgggagacagagcgagactccatctcaaaaaataaaaaattaaaattaaaagttagactggtgtggtggcatgtgcctgtagtcccagctacttgggaggccaaggcgggaggatctcttgagcccaggaggtcgaggctgcagtgagccatgattgtgccaatgcactcaagcctgggtgacagagtgagaccctgtgtctaaaacaaacaaataagtaagtaaataggttggccaggcaaagccatcctgagaaggtgacatttgagcaaagactgagaaagcagccaagcaacatctgggtggggagccctggggcagccaccacagatggcgcaaaggccctgggcttgctttctccagggacacatcagaggtccgggtggcaagggcgtggatggcagggccatgggtggaagggcagaagcaacgtggataagagaggtaggcaggggtcagatcggatgtggccaacttggcttctaccctgagtggggtgggagtggtctcagggctccaagcagaggaggggtggggtcagatgtttcatctgggtccctctggctgctgtgtggaaaacagcccggaggaggatgagatctcacacagggagaccagagctgagatgactgcaccagtccaggccagagaagacagaggctcaggccagtaggcagcagtgacggggcgaagagggatcagattctggatctttctctctctctctctctcttttttttttttttttttttttttttttttacagacaaggtatcactgtgttacccagggtggagtacagtggcgaaatcatagctcactgcagccttgaactcctgaactcaagcgatcccttctcctgagtctcccaaagtcctgggattacaggagtgagccactgtgcccagggcaggttatacattttttttgggaacaccacagaagccaagcacagtggctcatgcctgtaatcccaggacttctggaggcgaagatgagaggattgcttgagcccaggagttcaagaccagtctgggcaacacagcaagaacccatctctaaaaaaaaaggaatactgctgggcacggtggctcatgcctgtaattccagcactttgggaggctgaggtgggtggatcacctgagattaggagtacgagaccagcctggctaacatggcgaaaccccatccctaataaaaatacaaaaattagctgggcatggtggcagggacctgtaatcccagctattcaggaggctgaggcaggagaattgcttgaacccaggaggcggaggttgcagtgagccgagatcacatcactgcactccagccagggtgaccatgcccagccaactatgtaaatatcctatacacacacactcttctgatttcaccaatggttttaacactcactcttacctgaatccattattattatattggttatgtttatcattttttaaattctacattccttttacaattgttagctttcctacagtaaaataactttccagtggccgggcacagtggctcatgcctgtaatcccagcactttgggaggccgaggcaggtgaatcacgaggtcaggagttcgagatcagcctggccaacatggtgaaaccacatctctactaataatgcaaaaattagccaaacgtggtggtgcgcacctgtaatcctagctacctgggaggctgagggaggagagttgcttgaaactaagaggcggaggttgcagtgagccgagattgcatcactgcactccagcctgagcgacagagcaagactacatctcagaaaaaataaaacaaaaacaaaaaaaacttccatactgtcctacctcccttccctgctccctccctccttctctttgtctctaatattttcagaatcagtatgaactcattttcttttcttttttttttttttccaagacaaattctcactcttttgccgaggctggagtgcagtggcatgatctcagctcattgcaacctctgcctcccaggttcaagcgattctcctgcctcagcctcccgagtagctgggactaccggcgcccatcaccacacctggctaattttttggtaatttttagtagaaacggagtttcaccatgttggtcaggctggtctcgaactcctgacctcaggtgatcctcccgtctcggcctcccaaagtgctgggattacaggcatgagccactgcgcccagcctctttttttcttttaattaaaacaattaaatagagatggggttctctgtctgttgcccaggttggtcttcaactcctgggctcaagcaatcctcctgtctcgggctcccgaagtgctgggattacaggagtgagtcaccacgcccagcctaagtattgctcttctgtgatgatttgcaggcaacaatcacctcttgttcatattttcattatctttccctccaccccgagcctatagtctgtcttggtcagaccccatttcttgagtgcaccaggctggagtttggacccatccacatcctcgcagctctcctgagttggggcccaacatctggcttggggaacagacagctttgccgacagcagtaacaatttggttgaaatgataactttgtcaaaaatgaattttgccttagtgtttttttaaaggttgagaatcttgtacattcttacaacatttctattttctacagttaaaaaactgtaggctgggtgcagtgactcactcctgtaatcccagcactttgggaggccaaggtgggtggattgcttgagtccaagggttcgagaccagctaggcaacatagcaaaatattagctaggtgtggtagctactcgggaggttgaggcaggagaattgcttgaacccaggaggcagaggttgcagtgagccaagatcatgccactgcactccagcctgggcaagagagctagattgtctcaaaaaaaaaaaaaagtaagttccaattactttgcagccaattattcttgctcttctatttgcaatagcagaagattgaaatagcctcctagatgtctgacagtggaatgggttcttttctttttcttttttggtagagatgagggtctcactatgtggccaggcaagccttgaactcctggcctcaagtgatcctcccgcctctggaggcaggaggtagggtacagtcccagactcaaagcactgggattacaggagtgaaccactgcgtgagcctggtttcttttctttcccctccctcccttccttccttccttccttccatccgtccttccttccttccctccttctctcctctttcactctacctctttcttttcttcttttttctggcttgttaaaacagaaatacataataattatagtgaaataaactagggtatttactgcagcagttagtaataatgaaatgttggaaaacaatctaatgttcatccgtagggaatatttaaaatatagtgtatttctgccgggcgcggtggctcacgcctgtaatcccagcactttgggaggccgaggcaggtggatcatgaggtcaggagatcgagaccacggtgaaaccctgtctctactaaaaatacaaaaaagttagccgggcttcgtggcgggcgcctgtagtcccagctactcgggaggctgaggcaggagaatggcttgaacccgggaggcggagcttgcagtgagcagaaatcgcgccactgcactccagcctgggcgacactgtgagactccatctcaaaaaaataaattaattaaaaataaataaataaataaaatatagtgtatttctggccgggcgcggtggctcactcatgtaatcccggcactttgggatgctgaggctggcagatcacaagatcaggagatcaagaccatcctggctaacgcggtgaaaccctgtctctattaaaaatacagaaattagctgggcatagtggcatgtgcctgtagtcccagctacttgtgaggctgagacaggagaatcgcttgaacctgggaggtggaggttgcagtgagctgagatcgagacactacgctccagcctgggtgacagagcaagactccgtctcaaaaaaaaaaaaaattatagtgtatgccatggaatattatgcaactgttatatatgtgtgtgtgttcccaaagcattgttcagtaacaaaggaaaagtgcaaaacactaaaatggatgaatacatgcttgtgtaaacacagacactgtcaggaatgtttgtctggaggtgatgggtatggagcctttttgtctgatatattgggtgtatcaagaatgccaggtcctgagcagttttttttttttttttttgagttggagtctcactctgttgcccaggctggagtgcagtggcacaatctctgctcactgcaacctccacctcctgggttgaagcgattctcgtgcctcagcctcccgagtagctgggattgtaggcgcccgccaccatgcccagctaattttttgtgtttttagtagagacggggtttcaccatgttggccaagctggtctcgaactcctgacctcaggtgatctgcctgcctcggccttccaaagtgctgggcttacaggcatgggccaccgtgcccagccgtttatatgtattaactcttaatcatcaaaacaaactatgtggtattaccataattatcgccatttatacaaagcaacagagggataaggagattaaggcacttgcccaagtgcaagaggtaggacaggaacccagagtcccgtgctggtagctgcttttctgtgcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatctccaaagtggtgagtttatgtgtgatttttattttgtttatgctcttctgtattttccgaatttcatacaataaatatctgttacttttacaatatgaaaaaatagtggtcaaaaaggtgttcaagggggtggcctgggggtgtctggtttgaggagagtggtaggggatgaggctgcaagtggaggttggagccatgctatgaaaagttcaagagtttgaattgagttctgaggtttgtttttgtttttgtttttgttttttgagacggagtctcaccctgtcacccaggctggagtgcagtggcacgggttcatgccattctcctgcctcagcctcctgagtagctggaaccacacgcgcccgccaccacaccaggctaatttttttgtatttttaggagagacagggtttcaccatgttagccaggatggtctcgatctcctgacctcgtgatccacctgcctcggcctcccaaagtgctgggattacaggcgtgagccacagtgctctgcgtgagccatagtgctctgctgagagtttgaattgcattctggaagtagtggtgaaatcaacacacctaagtctgctcttctcctctcttctagtccccagagtggtgagtagcatcgttctggtggcccaggcaaaacgccttaggaccaccgtgcagccccactctttccccattcctgctctccaggtgccaagtccctggctcttcttccaccgacccttgcatcccttccttctcttcagtcctcatcgcacctcaccgggatcctattgacacttcccctttgatttccttccgctctctgctagtgatggtcccagggacccttctaaaaggtcactgtgggctgggcacagtggctcacgcctgtaatcccaacactttgagaggctgaggtgggccaatcatctgaggtcaggagttcgagaccagcctggccaacatggtgaaaccccatctctactgaaagtacaaaaattagccgggcgtggtggtgtgcacctgtagtcccagctactcgggaggctgaggcgggggaattgttggtccccgggagatggaggttgcagtgagccaagatcgcgccgttgcactccagcctgggtgacagaatgagactccgtctcaaaaaaaaaaaaaaaagaaaaaagaaaaatagctgggcatcgtggcacacacctgtagttccagctactcaggaggatgaggtaggaagatcacttgagcccaagaggtccagactgcagcgagtcatgatcacaccactgcactccagcctgcgtggcaccctgtctcaaaatataataataataaaatttaaaaataaaataaaacgctgctctgtctaggtgatattcctctatccccaaggctgtcagggtggaaccctccttccttagcgtggcatataagcccctcgggacctggccctatctctcctctgaccacccctgcccggtcagcccttgttacagacagtctgtgctatccagccccatcaaattcctgttgctccctaaatatgccacacactttatttggaggagaggggtgaagaagggtagtttaacatgttcaaaatatttattttttccagacagtaaaataacattttttcctgttttgcaaaagttaattatcagcacattgaagattttccttttttttcttttctttttttttttttttttgagtcaaagtcttgctctgttccccaggctagagtgcagtagcgcgatctcggctccacctcccgggttcaagtgattatcctgtttcagcctcccgagtagctgggactacaagcacatgccaccatgcccagctaatttttgtatttttggtagagacggggtttcacaatgttggccaggctggtcttgaactcctgacctcaggtgattcacccgcctcaccctcccaaagtgttgggattacaggcatgagccactgcgcccggccagcagtcttaaataacagaattcacacacacacacacacacacacacacacacacacacacgcactgtattatatttcatcttatactttaaaatgtttccttttttttcctcaaaagtacacattaagatcatgtttacaaataaagccttgtcatccaaagtgaaaaatccagatggcaagatttggatggggaaggtcttgagaaatctgcgaatggagttcacttttgcagacaggaaatgggccctaatatatggttctaaggacattccatttctgaaaatgtacatttccacccgcttttcctctccttccttcctccctccctccctccctctctctctctctctctctctttctttctttctgacaaggtcttcctctgtcgctgacgctggagtgcaatggtgcgatctcggcccattgcaacctccgcctcctgggctcaagtgatcctcccccctcagcctcccaagtagctgggaccacaggcacacgccacggcacccagctaatttttgtattttttgtacagatgggttctcaccatgttgcctaggctgatcttgaactgctgggctcaagtgatcctcccgcctcagcctctcaaaagtgctgggattacaggcgtgagccaccgcacctggcctgcatccccatttctgacccttgaccatgttcaagtgggaaggggaagccggggaagggaggacgggctacctgagggctgcgggtagaggtgactcctgtgagctgtgagccctcagcccttgggcagagggaacagaacagaaacagaccccatctctgagccaccaagctcagactcgtgtggcaggagacagatcacacaacactatcaacaaaacaacacaggtcgcagtggctcacacctgtaatcccagcactttgggaagctgaggtgagaggattgcttaaccgcaggagttcgagaccagtctggccaacatagcgagaccccatctctcaaaaaaagaaaaaaattagctgggcctggtgatgcacacctgtagtcccagctacttgggaggctgaggtgggaggacagcttgaaccagagaggtcgaggctgcagtgagctatgattgtgccactgccactgcactctagtctgagcaatagagtgagaccctgtcttccaaaaaaaaaaaaaaaagagagagagagagagaagaatataatcaaaagtttctaaattcccaaagtagtaacaaaagcagacccaaacaaaagtagagagaaaatcttcgaaacttaaaaggctatttaggctaaggagcccacccagtggtgaccacctagttctgggaggtttggggcagggccattagacaatggaaactcaggttattttggagacaatcaacttgctcccaaaaatgagctgcaagcaggtgcctgtgtgctcagcccagtctggagctcagagcctgcctgccccactgcaccatcaccagcccagctgaaccagggtcccaggcaagccgtacaggctctgcgttggccttggagagaaccgccgactcccccgagttgcctgagctcggcctgaagccagccctccccacgctggctcacaataaatgccttgacttcccgccaactcttcctcaaccattaagattcagctcaactgtcacgggctctgtgcagctgccctcgctgccccaccccacgcagactttgtgttccttctccactcctgcagcaccccttgcgacagcatgaataacccggctgtagtgatgtgagggtgacactcatcaccagtgtgtgagcccctccaaggccacatgtcctctttgtgtttccagagcccagggcccagcatgcggtagctacctagtatatgtttactgaatggagggatgaataaattcatgcacaaagaatagttttatttatttatttatttttgagacagagtcttgcttctgacacccaggctgtagcgcagtggtgcgatcttggctcattgcaacctctgcctcccaggttcaagcaattctcctgtctcagcctcccaagtagctgggattacaggcatgcgcgccaccacgcccggctaattttctatttttagtagagacgaggtttcaacatgttggccaggctggtctcgaactcgcgacctcaggtgatctgcctgccttggtcttccaaagtgctgggattacaggtatgagccaccgcgcctggccttatttgtttattttcataaacaaatttctgttgcccaggctggtctcaaactcctggcctcaagtgatcctcctgcctcagcctcccaaactgttgggattacaggcacaagccacagtgcctggcccagttctgtcctttgagttgacctggtcatccaggaggatgttctgaggaagtgtgaaatgataatattattctagcccacgctggatacagtggcagtctggaaggtgaaagaggttgggtttgaaatagatttattggccaagtgcagtggctcacacctgtaatcccagcactttgggaggccgaggcaggagaattgcttcagcctttaaacatggcgaaaccctgtccctattaaaaataaaaaagttcgatgggcgtggtggcattcacctgtagtcccagctactcaggagggtgaggcaggagaatcacttcagccctataggttgaggctgctttgtgctgtgatcatgccaatgcacgctagcctgggtgacacagtgagaccctgtttcaaaaacaaaaacaaaaacagaatagaggcctggagcttgagagggaactcaggatagaagatatagatttaagagtcggctggatgcagtggctcaaggctgtaatcccagcactttgggaggctagggtgggtgtatcacttgaggtcaggagttcgagaccagcctgaacaacatggcgaaaccccatctctaccaaaaataacaaaaactagctgggcatggtggcatgcgcctgtaatcccagctacttgggaggctaaggcaggagaatcacttgaacccgggaggtggaggttgcagttagccgagattgtaccactggattccagcctgggtgacagagtgagactccctctcaaaaaataaaaataaaaataaataaataaataaataaataaatagtgatacagatagatagatacataaattatatcattcactgggtagattgagaagagagctgtagagagaatctgagtgtaatagtcagggcaggctaactgctgtaagaaacagtgcccccacatctcagcggtataactcaaaagaagttttttccttcttatgacagtcaattcctgacatctggagcatgacctttcacaacattattccgggacccagtctccttccatctagtggctctgtcatcctcctagggccttggagtggtctgcttttgaccagctaatgggaggggagaggcagaataggatcctgtgaagacttctagggtcaggtctggaaatatcttttgctcacactccattggccagaacaagactgcctcagtgcagaggaagctgggaaatgtagtttagtagggtacccagaaggaaaagggaaacagtctctgccacactgaagcaacaccaaaatctgagggttggatgtaggaagaagcacctgcaaaagatagaaaagagcctttaagaggatcacctgaagccaggagtttgagaccagcctgggcagcatagcaagatcctatctgtacaaaaaataaaaataaaaaattagcctagggtggaggcatgcacatacagtcccagcaactcaggaggcttggggccaggagtttgaggctgcagtgagctttgattgggccactgcactccacttaagcctgagtgacagagcaaaaccctgtatccaaaaaaaaaaaaattaaccaggagaaaaatgacatttggagatcctgtctctaaagaaaaaaaaagctcactgcatagctcactgcagcctcagaaacaggcccaggactgaatcaaggccagcaaggtgctggggtgataagcgagcccgactccagcctggccaacacggtgaaaccccttctctactaaaaatacacaaattagctgggcatggtggcagacgcctgtggttccagctactcaggaggctgaggtaggaggatcacttgagcctggggcgtggaggttgtagtgggccaagattgtgccactgcactccagcctgggtgacagagcaagaccctgtctcaaaaaaaaaaaaaaaaaaaaaagtgagctggaggatgaggcctccctaaattttgtgccttgggtgtctcgatccgtcacgccagccccagtcccggcagtcaggtgcggcagagaaagcaaagggagaaggctgggaagatgcaagtgaatttagcgactagcagtccctgtgagcaactgtagcaagaagggtttccaatgaagaaaggaaggccctgggccaggcgcggtggctcatgcctgtaatcccagctctttgggaggcagaggcgggtggatcacctgaggtcgggagctcaagactagcctgaccaacatagagaaaccccgtctctactgaaaaaaaatacaaaattagccgggtgtggtggcgcatgcctgtaatcccagctattcgggaggctgaggcaggagaatcgcttgaccccgggaagcggaggttgcagtgagtcgagatcacgccattgcgctccagcctcggcaacaagagcgaaactccatcaaaaaaaaaaaaaaaaggaagaaagaaaggccctggcagttcttggacaggaacttgcctgaagtcccagtcccggtgactggtggtttccccactttctggttcagaagctgggctctaagctgtctgtgcccttaaagttccttggaaagagggaagggaagggaagtggatattaggtgagttcctactctgtttcatttgcagagttttctcattgattctcagttggacccatgaggtagatgttatgccattacattttttttttctttagagacagggtctctctctgtcactcaggctggactgcagtggcacgatcacggctcactgcagctttgaactcctgggctcaagtgatcctcccatctcagcctacaggtgtgcaccactgtacttagctaatttctttttcttttttctttttttgggagagatgggatctctgtatgtctctatgatgcccacactggtctcaaactcctggcctcaagcgattctcctgccttggcctcccaaagcacagggattacaggcatgagtcgctgtgcccagcctgttatgccgggtttttttgttttgttttgttttttgagacagagtctcgctctgtcgcccaggagtacagtggcatgatcttggctcactgcaagctccacctcccgggttcacaccattctcctgcctcagcctcccgagtagctgggactacaggcgcccaccaccacacccggctaattttttggttttttagtagagacggggtttcaccatgttagctgggatggtctcgatctcctgacctcgtgatctgcctgcctcagcctcccaaagtgctgggattacagtcgtgaaccactgcatccggcctgttatgccgttttttaaattaattaataaatttatttatttatcttgagacagagtctcactctgtcacccaggctggagtgcagtggcatgatctcgactcactgcaacctccacctccggggttcaagtgagtctcatgcctcagcctcctgagcagctgggattacaggcggccgccaccatgcccggctaatttttgtatttttagtagagatggggtttcgccatgttggccaggctggtctcaaactcctgacctcaggtgatcaacctgcctctgcctcccaaagtgctgggattacaggcgtgagctcctgtgcccggccctgttatgccattttaaagctaaggaaactgaggcacagaaaaaggtaaaaaggtacttgagatcaaaaaggatggagttaggatttgaacccaggtccagggcccatgattttcccagcacaccatccaaaatgcctgcctgccctcaccagggagcacatgcttacattcacagccttggaccctgggttagggccaggagggctgggtgttgggtgagaacagggcctcgggctccttcactggctggggcagggcttctgagttccccatcagagcccctcctctgactttcagggcctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccattctcctgcctcagcctcccgagtagctgggactacaggcgcccgccgccacgcctggctaattttttgtatttttagtagagacggggtttcaccatgttagccaggatggtctcatttcccaacctcgtgatccgcccgtctctgcctcccaaagtgctgggattacaggtgttagccaccgtgcccggccaactaagataatctttaacttattgggctgcagctggtgggagtgggttttacaaggagccaggatgtctggtcacattccaacgcttcaaggaagtgtttcagcccagagcattctgtgtaaagccgcagagcaggtcatgttcactggcctggggacacaatggcaataaggaggtgattctcctcagaggccccctatggtgttccataggtgtcctacacaggggtggctgactaaactggcgccccgtaaacccttccaccagcacaaacccaggggtccatgctctacgctcagaaggctccaccagggatggggctgtgtgaccatgggtgggtcctggcttctcagagtcccgttttcttccatctgtaaaatgacaataatagttccctgctctggcccgccacggtggctcacgcctgtaatcccagcactttgggaggctgaggtgggtggagcacttgaggtcaggtgtttgagaccagcctggccaacatggtgaaaccccgtctctactaaaagtacaaaaattagccgagtgtggtggtgcgcacctgtaatcccagctacatgggaggctgaggcaggagaattgcttgaaccccagtggcggaggttgcagtgagctgagaccaggcctcagcactccagcctgggcgacagagcgagactccatctcaaaaaaaaaggaaaataaatagttccctgctcagaaggttgtggggaggacagaggatgggaggcacaggtgcttagaccctcctccatgtttgaggtgcctgctggccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaatttgcaggtgaaattgtgtgtctttgtgagaacacggttacgcatttttctgggaaggagatccataattttcatcagatccagattctttttttttttttttttttttgagacagagtctcgccctgttgtccaggctggagtgcagtggcatgatcttggctcgctgcaacctctgcctcccgggttcaagcgattctcctgcctcagcctcacgagtagctgggactacaggcataaaccaccatgcccggctaatttttgtatttttagtagagatggggtgtcaccatgttggccaggctagcagatccagattctttttttttttttttcgagatggagtctgactctgtcaccaggctggagtgcagtggcaggatctcggctcactgcaaccttcacctcccaggttcaagtgattatcttgcctcagcctcacgagtagctgggactacacgtgcttcaggcacttgctgccatgtccagctaattttgtagttttagtagagacagggtttcaccatgttggccaggatggtctcgatctcttgaccttgtgatctgcctcctcggcctcccaaagtgctgggattacaggtgtgagccaccgcacccggcctcttttgttttttagacggggtcttgttctgtcacccaggctggttggtgtgcagtaacataatcatagctcactgtttgtagcctccaacttctgggctcaagtggtcctcctgcctcagcctgtggagtagctgggactgcaggcgtgtgccaccacacctggctaattaaaataaattttttttttttttagagatgggttcttgctgtgttgcccaggctggtctcaaactcccagcctcaagcgatcctccaacctcagcctcccaaaagtgttgggattacaggcatgagccaccgtgcctggctcaaatcttttcatatgtgaacatctcagcatgttttctttctttcttttttgagatggagtttcgctcttgttgcccagactggagtataatggcgtgatcttggctcactgcaacctctgcctcccaggttcaagtgattctcctgcctcactctcccaagtagctggggatacaggtgcccaccaccatgcccagctaatttttttgcatttttttttttagtagagatgggttttgccgtgctggccaggctggtcttgaactcctcacctcaggtgatccacccaccttggcctcccaaagtgctgggattacaggcgcaagtcactgcgcccagcctcatcatgtttttttcttaaaagataaagacttttctttttactacaaccacaatactattgtcaaaactaaactttaaaaatttccttggtgttatcaaacattcaatgtccagattccagtggtttcataaatagcctaatttgcttttagtttgtttgaattaggatctaagtaaaatctacactttgtgattggttagtatgttttaagagtctttgaaactttatttttttgattaaaaaatgtttaatttagagataggggtctcactatattgcacaggctggtctcaaatgccccaaagtgctgggattacaggtatgagccaccacacctgactgattctttttttttttttttgagatggaatctcactctgttgcccaggctggagtgcagtggcgcaacctcggctcactgcaacctccgcctcccagattcaagcgattctctcaccccagtctcccgagtagctgggattacaggcgtgcaccaccacacatggataaattttgtatttttttagtagagacagcgcttcaccatgttgtccaggctggtctcgaactcctgacctaaggtgatcttaggcccaccttggcctcccaaagtgctgggattacaggtgtgaccaccacgcccagccaatatgtggtcttatgagagcattggttcttttttttttttccctgaggcagggtctcaccctgttgcctaggccagagtgcagtagctccatcatagctcactgcagcctccaactcctggactcaagggatcctcccacttcagccttctgaatagctaggactacaggcgtgtgtcaccatgcccagctaatttttaaaattgtttttgtagagatgggttctcactatgctgcccaggctggtctcaaactcctggcctcaagcgatccttctgcctcggcctcccaaagtgttgggattacaggcatgagccaccgcccctggccgagcattgattcttgatcctcatgtgcatctgagtcacagagcagggtgggggctggctcttccccaacctggatccctggaaactacccccagagattctggttcactgggttggaatgggcctgagcatctgaaagtttgaaaagctccctgtgattctggtgtgcagcccaggcagaggccccactgtgtccacttctcttgaaaggagtggttcacaccaacacccccacttccctacctcccgtgcgctcctcgagcatgacaatgtggcttctgcccccgacacatggcacaaaaaccgctctggcacaggcctcacagttgctaagtgcagagccccatcctcagtcttccttctatttacttctgctcacctcccaaaaccctcttctccttcccaggtacccactcctgatgatgcttctctttttgttggacatgccctgtgggttctttatcttattattttattttagagaccgtggcttgctctgtcacccaggctggagtgcagtggtgcaatcacaggtcactgcagcctccaactcctggactcaagccgcagcctcccgagtagctggcgagtagctgggactacaggcgtgcacccccatgcccagctaactttttctttttttcttttgttttttgagacggagttttgctcttgttgcccaggctggagagcaatggcactatctcggcttactgcaacctctgcctcccaggttcaagcgattctcctgcctcagcctcctgagtagctgggatcacaggcgcccaccaccacgcctggctaatttttgtatttttagtagagacggggttttgctatgttggccccggagttcaatttttgtatttttagtagagacggggtttcaccgttttcaccaggatggtcttgatctcctgacctcgtgatcctcccgcctcggcctcccaaagcgctgggattacaggcgtgagccaccgcgcctggccacggcagcatctcttctgaactccagagccattccctaccaccctctgggcaccaccatccacatctcctgctgccgcctcagccttaacctctgcaaaaccaaatccgttctttctctcgagctctgcagaagctaagctgtttcaccaggccacgattcaggaaacgctttgggattcagcttctgttcttgtgaaatgggaagaatccctgtggtgagctccagatgagagcacaaaggggaacaggggtgcccgcggctggcacgccatggctggcacgccatggcactcagtggggtcaccgccccctcctgctgtcccacctccaccctgcctgctcttctcctggaatgactccttctgccagctctcagctacccaggccagaggcccaaggctcccacatctctttagctactaattctggtagatccccttttggaaatagccctcaaatctaccccagagctactgtcaaagttcagggctccatctcttttggtttttttgaaaatattttttcaaattaattatttgttggccgggcgcagtggctcacacctgtaatcccagcactttggaaggccgaggcaggtggatcacctgaggtcaagagttcaagaaccagcctgaccaacatggtgaaaccccatctctacaaaaatacaaaaattagccagggatgatgctgcatgcctgtaatcccagctactcgggaggctgaggcgggagaaccacttgaacccgggaggcagaggttgcagtgagttgagatcacaccattgcactccagcccaggcgacagtgagactccgtctcaaacaaaaaaaaattatttgtggaggcagggtcccactatgttgcccaggcctcaagtggccctcctgccttggcctcccatagcactgggattacaggtgacagccaccgcgcccagcctactttttgtctggccaagactacctcagccttcttttgcctcccaatctgtctccagttggtggctgaagtgacccttctggagcaaaaccataatcatatcactccctcttttaaaattctgtgatgggtcaggcatggtggatcacacttgtaatcccagcactttgggaggccgaggtgggaggactgcttgagcccaggagttcaagaccagcctgggcaacatagcgagaccccccgtctctacttaaaaataataaaataaaatgaaaagaaaattttttttgagatggagtttcgctcttgttgcctaggctggaatacaatggtgggatctcagctcacggcaacctccacctcccgggttcaaccgattctcctgcctcagcctcctgagtagttgggattacaggcatgtgccaccatgcccggctaattttgtatttttagtagagacggggtttcaccatgttggtcaggctggactcgaactcctgacctcaggtgatcggcccacctcggcctcccaaagtgctggaattacaggtgtgagccactgtgtccggccaataaaatgaaattttatgatggcttctgcgatctggccaaattcctcagctaaatagtttagttctttctccctgtggcctctcctcccaccatgtcacctgtgaatcccacactgcccccaccccgacactgtctgcaggtgaacagatcagttttctcagccccaaatgtcagccccaccccacacctctgcctggcaaacatcactcaccggtcctcagagacacctagtcatttattccatgagtccaccacacttgagaaacgcttcttttcttcgcgagcacgcctaccctgtgctagacagtgttcctaagggctttcaaacataaagtcttttgttttttgtttttgagacgcagtcttgctctgtcgcccaggctggagtgcggtggcacaatcttggctcactgcaacctccgcctcccaagttcaagcaattctctgcctcagcctcccgagtagctgggattacaggcgctcggctttttatttttttaattttttttattttttgtatttttagtagagacggggtttcaccatcttggccaggctggtcttgaactcctgacttcaagtggtccacttgcctcggcctcccaaagttctgggattataggcgtgagccactgtgcccagcctccaactcctggccttgtcttcctcccaccctggcttcccagagtgctgggattaacagacatgagcctccacacctggcaacttctttccatttttcactgattctctgacacatcctcattgagcacctgcactgtgtggggtgttaataattgctaggcatggaggcaacagcgtgggcagctctttctcttacttgtcaggctttagcctatgctgttgcaggactgtgccttggcctggaagccccttcccttatcctcatccccaatctcccccttcagctcttgttcctcttgcaggtcttcccttaaacatcacttcctcagcaggggcctcacagacacgcccggaggttagatcctggtccctctgtgcttcctgttcttcccccatcatcacagtctacggctgtttcctctcgatgggcaaagactgtgtctggccattgagttttctgctatatccaagtgcttcgtatactgaaccatataaatgtgctgcttttattggtcaaaacggccaaatattggcaattttatattggttagcttcatagtatgtgagctaggatacttatcccatcagagaggttgcgtagcacagtgaatcagagcccaggctctggggccgcacacctgaggtccagccctggctctgccacttgtcactaagtgattgtggactggagacaaccctcaggggccttgggttcctaatctgtgacagggatgacaataatgacctcctcgtgctgttataaaatacagaaatgtactaaaatacaaaaattggccaggcatggtggcacatgcctgtaatcccagctactcaggaggctgaggcaggagaactcaggaggcagaggctgcagtgagtctacttttattgccaaagctcgggggtccatcccttttccattgcatgccactgcactccagcctgggcaacaaagtgagactgtctcagaaaaaagaaaaagaaaaaaatgtttaaaagccaggagtttgagaccctgtctctattaaaaaaaaaaaaaattaccttggcatggtggagcagctactcaggaggctgaggtgagaggaccacatgagcccgggagttcaaggctgcagtgagccatgattgcaccactgcattccactctgtctcaaaaagaaagaaagaaaaaagtcaagagaactggagctgaaaccatgaaaggtcagttttcagcaggagagtgatcaaagaaaaccagaactagacagtcgttaaaatagcaaaaacatattgcattccagactattgctgtaggggaagagtgaccttagatcagaactgggctgaactctacaccatgggggttatagccaacgagcagagttgggggcagtggatgggacattaccatgagaaagcactgggggttgggggtattctgacaagaccaacctaaagggattcttgctgagggcaggccaaggtggtcagacagcgcctgggggagagtggagaatgaggacccccatcagggatcgggggcaatcagatgtggaggatgagggactggctaagctgacttagcagtattcttgctaaaattggacgatgcagaggtgaacacggaagtccaaggcctaactggaaaagagctgagggaacctgagtgaggtttggctatagacagaacctctgagtgagcccatcaaagttactttatttatttgtttgtttattaatttatttaagacagagtctcactctgtcgcccaggctggagtacagtggtgctatctcggctcactgcaaactctgcctcctaggttcaagcaattctcgtgcctcagcctcccgaggagctgggattacaggcacatgccaccacacccagctaagttttgtgtttttagtagggacagggttttgccatgttggacaggctggtcttgaactcctgacctcaggctaattttttgtttgtttttattctctttttttttttttttgagactgagtttcgctcttgttggccaggctggagtgcaatggcgcgatattgactcactgcaacctctgcctcctgggttcaagcgattctcctgcctcagcctcccgagtagctgggactacaggcgcacaccaccatgcccggctaatttttgtatttttaggagagacggggtttcataatattggtcaggctggtctcaaactcctgatctcaggtgattcgcctgcctcagcctcccaaagtgctgggattacaggcgtgagccaccgcgcccagccttttgtttgtttttaaatttaactttttttttgagaccgaattgcactctgtcacccaggatggattgcaatggcgcaatctcagctcattgcaacctctgcctcctgggttcaagagattctcctgcctcagcctcccaagtagctgggattacaggcgcctgccaccacagctggttaatttttgtgtttttagtagagatgaggttttgccatgttggacaggctggtcttgaactcctgacctcaggtgatcaacccaccttggcctcccaaagtgctgggattacgggcatgagccaccatgcccggccttaacttttatcttaagttcaggggtacatgtgcaggtttattatataggtaaacttgtgtcatgggggttgtacacattatttagtcacccaggtattaagtttagtacccattagttatttttcctgatcctcttgagggaagagagagaccctctcatattgtttcatactcagaaaaggaaagagaagcgaaactaaaggcaggtagcctggtgcctaggaaccagaccggaaaccaaggaaccagacccgaaatcaggcctgggcgtgcctgacctaagcctggtagttaaaattcgacccctgacctagcaactgttgttatctatagattccagacattgtatggaaggacattgtgaaacctcccgttaggttctgtttcactctgaccaccggtgctcgcagcccctgtcacgtaccccctggcttgctcaatcacgaccctctcacgcggacccccttagagttgtgagccgttaaaaaggacagaagttgagcacctgaagagctcggattttaagacgctagcctgccaatgctcccagctgattaaagccactcccttcactatcttggtgtctgaggggttttgtccacagctcgtcttgctacacttgccctcctccaaacttccgccctccaataggctccagtatgtgttattcccctctatgtgtccatgtgttctcatcatttagctcccacttataagtgagaacacgcggtatttggttttctgttcctgcgtttgtttgctaaggataatggcctccagcgccatccatgtccctgcaaagaacgtaatctcattcttttttgtggctgcatagtattccacggtgtatgtgtaccacactttctttgtccagtctagcattgatgggcatttaggttgaatcatgtctttcctatggtgaatagtgctgtgatgtgtctttataacagaatggtttacattcctttgggtatatacccagtaatgggattgctgggtggaatggtatttctggtttttggtctttgagaaattgctgcactgtcctccacgatggtttaactaatttacactcccaccaacagtgtataagtgatcctttttctttgcaacctcgccagatctcggtggtcaactcctcccactccccaggcaatgctgatttgctctgtgcctatagttttgcctttcccaggatgctgcgggaatgggatcatacggccttttggatctggctccttttagttagactgatacatttgagacaggtccctattgttgtgtgtatcagtagttggtttcttctttttttgagatggattctcagtctgtggtccaggctggagtgcagcggcatgacctcagctcactgcaaactccgcctccctggttcaagtgattatcctgcctcagcctcccaagtagctgggattacaggcacatgccaccacgcccggctagtttttgtattttttcgtagagatgggatttcaccatgttggagaggctggtcttgaactcctgacctcgtgatctgcccaccttggcctcccaaagtgctggaattacggcgtgagccatggtgcccagcctgcatcacaggttgtttacccaatactcaccagttgcagaattcaaatccattttttaaaaaatcagcctgaaaaaaaaagaaaaaaatcagtctggccaggcacggtggctcacgcctgtaatcccagcactttgggaggccaaggcgggaggatcacctgaggtcaggagtttgagagcagcctggccaaaatggcaaaaccctgtctctactaaaaatacaaaaattagctgggcgtggtggcgggcacctgtaatcccagctacttgggaggctgaggcagaagaatccctggaacccgcgggacggaggttgcagtgaggtgacatcaggccacttcactccagcctgggcaaaagagtgaagctctgcatcaaaaaaaaaaaaaaaaaaaaaaaaaaaaaatcagggtgggcacagtggctcactcctgtaatcccaggactttgagaggctgaggtgcgaggattgcttaagcctgggagttcaagacgaggctggggaatatagtgagacccccatctctacaacaaaaaatatacaaaaattagccgggcatggttggtgtgcgcctgtagtcccagttccttgggaagctgaggcgagaggattgcttaagcctgggcagttgaggctgcagtgagccatgatcgtgccactgcactgcacctagtttgaatggagtgggagtgggggattaggctctcctccctgccgtttgctcccaggccttttccgtagctggatgtgaccaacagagacagtgcccagcctcagtatagctagctcttagtggagggacaggagccatctggggcagatgtgggagagaatgtggcgaaggagagccgggtgcagtcaaggaggcttgtggctcggaggggaggtggggtgagtgagtggagactcagcagcttggctttggggaagtagacaagagagggccctctttggagagcggagcaagccaggatgtctggccttcacttccacttggaacagaagtgtgctgtgtgcgcgtgcttgtgcgtgtgcgtgcacgtgtgtgcgcgctaaatcaaacaccctcgctggctctgtgttcccctcaaggggaagccaactccacggatggcgggggtccattaggctgcaggtcttctccctgccgatagatggcgctgttgcaccgcgcctgggtttgcctctgcccgcagccatgcagggcccatcacgggctatgcctaccgcgcgaggggccttcaccatgtccactatccttatttatttatttatttatttatttatttattttttaagtgtgggtactggccgggcgcggtggctcacgcctgtaatcccagcactttgggaggccgaggcgggcggatcacgaagtcaggagattgagaccatcccagctaacacggtgaaaccccgtctctactaaaaacacaaaaaaattagccaggcgtggtggtgggcgcctgtagtcccagctactcgggaggctggggcaggagaatggcgtgaacccgggaggcggagcttgccgtgagccgagatcgcgccactgcaacagaacgagactatctccaaaaaaaaaaaaaaagtgtgggtatatagtaggtgtatatatttatggggtgcacattgataaaggcatgcaatgcataataatcacatcatgggctagatgcggtggctgacgccgagatcgcgcctctgcagtcgccaggccactgcaggcgccacagtggcgacagagcgagactccgtctcaaaaaaacaaataaataaataaatcaggttaggccgggcgcagtggctcacgcctgtaatcccagcacttgggaggcggaggcgggcgaatcacgaggtcaggagttccagaccagcctggccaacatggtgaaaccccgtctatactaaaaatacaaaatttagccgggtatggtggcaggcgcctgtaaccccagccactcgggaggctgaggcaggcgaatcgcttgaatccggaaggcggaggttgaagcgagccgagatcactccattgcactccagcctgggcaacaagagtgagattctgtctcaaaaaaaaaaaaaaaaaattacatcatagagaatggggtgtccatcccctcaagcatttatcctttctgttacaatccaattgcattcttttagttatttcgaaatgtacagttattattgactgtagtcaccctgttgtgctagcaaatagtaggtcttattcattctttctattttttttgtacccattaaccttccccacctccccatcatccttttttttgttttgagacggagtcttgctctgtcacccaggctggagtgcagtggcacgatctcagctcacttcaacctctgcctcctgggttcaagcgattctcctgcttcagcctcccgagtggctaggattacaggcctgcgccactatacttggctcatttttttcggggttttgccatgttggccaggctggtcttgaactcctgacctcaggtgatccacctgcctcagcctcccaaagtgctgggattacaagcatgagccactgtacccagccccatcatcctcattttatttattttttatttttattactatttttttaggtggagtcttgctctgtcacccaggctggagtgcagtggcgtgacctcggctcactgcaacctctgcttcccgggttcaagcaattctcttgcctcagcctcccgagtagctgggattgcaggcgcctgccaccacgcccggctaatttttgtatttttagtagagacaggagggttttaccattttggctaggctggtctcaaactcctgacctcaggtgatcctcccgccttggcctcccaaagtgctgggattacaggcgtgagccaccgcgcctggccagactgattttttttttaagtgaatttgaaagctgcaactggtgagtattggataaacaaactgtgatgggattgcaggtgtccacccccaagcctggctaatttttgtatttttagtagagaccatgttggccaggctggccttgaacccctgacctcaagtgatctgcctgccccagcctcccaaagtgtttgggattacagtcgtgagccaccgcacccggtcagaagtttaatttttttttttgagacggagtcttactctgtcaccccggctggagtgcagtggcctgatctcggctcactgcaagctccacctcccaggttcacgccattctcctgcctcagcctctggagtcgctgggactacaggcgcccgccaccaagcctggctaattttttcgtatttttagtagagacggggtttcaccatattagccagaatggtctcgatctcctgacctcgtgatccgcccgcctcggcctctcaaagtactgggattacaggcgtgagccaccgcgcccggcccagaagtttaaatttaactaggtgcccagtgatctcatcaagcccacagcactccctcaccctcgcccccacaacctcccttccccccacgccccccttcctcaccgcagtcccccccctgggacccctagatcttgaggctgatgggccagttcccagtttcactggttgttaaatattttgacagtgacccctgacagcaggagaggcagccaaactcaacagctgttctctcttccccccaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggtgctggtcctgcctgtccctggtccaaccccaccctcagcacacccctcccctcccctcccctctccagagcctccagccatgaccgggtgaacagccatggcctggagtcagcaacacaagactcttcccacctcagctcctccatctgagctgggctcagttgagctcatccagctaagctaaaggggagctgggcctgcttttctttttctggagatggggcctcagtctctccagtagctggatatacaggcatgctccaccccactggctaatttttgctttttttttttttttttttttttgagatggagtctcactctttcacccaggctggagtgaagtgatgcaatctcggctcactggaacctctgcctcctgggttcaagcaattctcctgcctccgcctcccgagtagctgggattacaggcgccagccaccatgcccggctaatttttgtattttttagtagagacagggattcaccatgttggccagactggtctcaaactcctgacctcaggtgatccacccacctcggcctcccaaagtgctgggattacaggagtgagccactgcacccagctgccttttttttttttttttttttttttgagatggggtctcactatgttgcccaggctggtctcaaacttctggactcaagtgatcctcccaccttggccacccaaagtgctgggattataggcataagccaccatgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcagtggctcatacctgtaatcccagcactttgggaggcccagttggggggattacttaagtccaggagtctgagaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaaaacagtggccaggtgcggtggctcacgcctgtaatcccagcactttgggaggctgagatgggtggatcacgaggtcatgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaatccggtgcctgaggagttttgtctgtggctcgtcctgctacaagaggacacagcccagaggtgccacctgcagctgccctgtcccctctaatcccagctccaccctgcctgctcccgtccttcctccagggggaacatggacacgctcagatgaaccccagcttcttatgcctgaactggggaaactgaagccccatgggaccaggggttccactgggcatcaagggaggaaagttgagccccggggtgatctgggaactgggatctgggatctgggcaggcattggggcctgacagagcagaagtgaggagagggtaccaggagctgcaaactcggtgcctccaggacctattcggataaaataaatgggtggaactggaataagacaaagtgggggtgcgctgtggccaactggaaaatgctcgttgcagccacagcgttccattaaaaaagcgaaaggaacctgcctgcctgagtcttaagctccccctaaacccagaaatgggttagccctccagtatcctccagctctgagagctggggcgggcactccattactgggggaacaggaaatggatcctgggcactctagggcaacacacgccctccttgcagggaaatggatttccaggcaggggagatgcatgggcagaggtggcttggattgtttgctgtaagatttgaagctgtgatcaggaggtggctaggagatgggctgggtccagaccacaaaatggtagatcggaggatttggactctgtctcatgagtgagctggaaatcaagctggaaaatcagataagcttattcgcagcttcaatccagtccgttgcagaaggatgcatttgagggggctagagcagctgcagggaggccaggaggagctgtggaagaggacttgagtgtgggtcatggccatggggtttggagagaagtgatacagtgtcttcagagcttcagaaggcagagggagttcgatggctcaaggcagttggaagagttgggtgtgactgagggggtggggaaatggggcatgcgtggcaggcaaggactcttatgcatcacctcccagtcccttgtccatctggctacacttcctctttgcctggccagcctaggaccaagctgggatcatttccccaggatgccccacagacaatggcaaatgtgcccatcatagcagtttgtttaatgaaaatgatatgctgttgtgagtacgggatgtgccagcaatgctggctactgcatgagacgggagctagcagggagcaccttcatccagggtgtgcaggtccccttccctcagttaatgctcgtgggggcgggcgttagcctctccacttaccgaagaggagactgaggctttataaagttaagagagctgcttagggtcactcatcaataaagtggtggaggccagtcatggtggctcacacctgtaatctcagcactttgggaggctgaggcaggaggatcacttgagcccaggagttcaagaccagcctgggcaacatagtgagactcaatttctatttttaaaaaattatccagctgtggtggtgcacacctgtagtcccagctactcaggagactggggtgagaggatcgcttaagcctgggcagttgaggctgcagtgagctgtgactgcaccactgcactccagcctgggtgacagaggccctgtctcaaacaaaaataaataaataaataaatatataaagtggtggagcagtttgaattgtgtcattcactcattcaatatttaactgagcatctactgtgtgccaggcactattctagacaatgaacatacaacgagtaaacagataaaaatctctgtcctcagggagtctgtatgttggggttggggtgggggcggggaagaatagacaatgaaaaaatacttaaggaaaatatgtagacaccaattgtcctgatggccacccctgatggccaccagagggcactgcaaccacgcggccctccgttcgtctctaattccagctccctttccggattccgaagg
